United States Patent 7,745,391 (HUMAN THROMBOSPONDIN POLYPEPTIDE) - sequence listing, part 126

SEQ ID NO: 353173 - DNA, 1753 bp, Homo sapiens
  misc_feature (35)..(36): n is a, c, g, or t
  misc_feature (40)..(40): n is a, c, g, or t
  misc_feature (44)..(44): n is a, c, g, or t
  misc_feature (47)..(47): n is a, c, g, or t
  misc_feature (53)..(53): n is a, c, g, or t
  misc_feature (58)..(58): n is a, c, g, or t
  misc_feature (73)..(73): n is a, c, g, or t
  misc_feature (119)..(119): n is a, c, g, or t
  misc_feature (124)..(124): n is a, c, g, or t
  misc_feature (131)..(131): n is a, c, g, or t
  misc_feature (136)..(136): n is a, c, g, or t
  misc_feature (140)..(141): n is a, c, g, or t
  misc_feature (145)..(145): n is a, c, g, or t
  misc_feature (153)..(154): n is a, c, g, or t
  misc_feature (160)..(160): n is a, c, g, or t
  misc_feature (163)..(163): n is a, c, g, or t
  misc_feature (168)..(168): n is a, c, g, or t
  misc_feature (178)..(178): n is a, c, g, or t
  misc_feature (208)..(208): n is a, c, g, or t
  misc_feature (219)..(219): n is a, c, g, or t
  misc_feature (221)..(221): n is a, c, g, or t
  misc_feature (228)..(228): n is a, c, g, or t
  misc_feature (269)..(269): n is a, c, g, or t
gcgcagcgtcgcacctctgcccaatgaggtgcccnngacntgcntgntgcggntgccntgctcccccccagcntccctgcatcccgggatgggggagggcgccaggcgcagctcccggnccctnaggggtntcccngccnnaccncaccagcnngggttnggnacctnggggctcagntgtgcagtcagctgttaatgtggcaaaatntggggaagtcntntgcagcngcaaaatccagttcccaccagttggaggccgggcggggaanggtggggacagacagcactccgctgtgggaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctc

SEQ ID NO: 353174 - DNA, 1546 bp, Homo sapiens
  misc_feature (1)..(1): n is a, c, g, or t
  misc_feature (3)..(4): n is a, c, g, or t
  misc_feature (7)..(7): n is a, c, g, or t
ngnncangacaaaaaaaaaggtctctccgatttcctctgctcaaccagttccctggctacctgaggccctgcttcacctggaggaagacagtggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctc

SEQ ID NO: 353175 - DNA, 883 bp, Homo sapiens
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggtgagtggtgggggccggggcggagtctgtgggtcaggacgcccgcggctgggtcggccccgccccgcctcctcttggcctcggtttcctcttttgctcgtggggcgcgagtggccacgtgatgtggctactggggacgtctgg

SEQ ID NO: 353176 - DNA, 2063 bp, Homo sapiens
  misc_feature (1539)..(1539): n is a, c, g, or t
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctcaaaaaaaaaaaaaanaaaaaaaaaaaaaaaaaaaaaaaaaaaaagggggggggcggttaaaaagattcccccgggggggccccaattttagcgcggaaaccaagagtatttgtggaacaaaaggggcgccccattatagagggcggcatataaaaaaagcacaaagcacacgtgccacgccctttaaacacagctgcaagcagcgagaaaaacacgagaaaacagggagaaaacctcggaggaagagaaacactaaacaccagcgagaggggagagcccaaaacaagctgcgccaccaaaacacaccgaagcagagcaacaatttttacacgcgcgccacacgaggggagcaacaaccaactccaacgcacactccaaagcaggcgactatccaaagagcggcggctcacaacaacagccgcggcgaccatttaccgagtcgccagccgaaatagaaaaaaaacggaccaacacacgagcaaaacagtagcttacaagagacaaaatttgtaactccagaggacaacaggcaaaaaaac

SEQ ID NO: 353177 - DNA, 1180 bp, Homo sapiens
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgcttgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctc

SEQ ID NO: 353178 - DNA, 1773 bp, Homo sapiens
  misc_feature (1773)..(1773): n is a, c, g, or t
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctcgtcccaaagcctgtgctttgggacggcggatgtgatacagatagcaagagaactagaattagaagttggaacgctgaagattgggcctgattgccagaatctcatgataaaacttgaatggatgaggagttgcatcttatggaggagcacagaaagtggttcctcagatgaagtctactcctggtgaagatgctgtgaacattgttgaacgacagcaaggatttagatattccctaactttgttgataaaccggcgttggaagattgctcccgttccaaagacgtctcn

SEQ ID NO: 353179 - DNA, 1065 bp, Homo sapiens
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacaggctggtctcaaactcctggcctcaatcagtcctccctcttcggcctcccaaagtgctgggattgcagacgtgactttgagggctcttataacagagagc

SEQ ID NO: 353180 - DNA, 746 bp, Homo sapiens
ctccggcaggcagggaggcccagagaggcaggaaggcccagacagggaaggcgttaggaggggaggcccagacagggaaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctc

SEQ ID NO: 353181 - DNA, 1104 bp, Homo sapiens
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccaggtagggccgggggactggagtccaggtggggccgggtcgggggcagcctgcggaggacccgggacacctccagggaggtctgcgtgcgcgcggggtctggccctaagggctggacgggggtggggggcgacgtggggcgtggcttgtggaggggcgggtcagggggggaaagggccccaccgaggggctttcgccgctcagctcccccgccccgtccccagccgcccagatggtcatcacggacctgtcggcacccgaggagcggcccgcggccctgggccggctgggcctctgcttcggcgtcggagtcatcctcggctccctgctgggcgggaccctggtctccgcgtacgggtgagtggtgggggccggggcggagtctgtgggtcaggacgcccgcggctgggtcggccccgccccgcctcctcttggcctcggtttcctcttttgctcgtggggcgcgagtggccacgtgatgtggctactggggacgtctgg

SEQ ID NO: 353182 - DNA, 1524 bp, Homo sapiens
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctc

SEQ ID NO: 353183 - DNA, 1021 bp, Homo sapiens
  misc_feature (784)..(784): n is a, c, g, or t
  misc_feature (822)..(823): n is a, c, g, or t
  misc_feature (825)..(825): n is a, c, g, or t
  misc_feature (828)..(828): n is a, c, g, or t
  misc_feature (844)..(844): n is a, c, g, or t
tggctaggtagagcccggtgtgatcggccgaggctgtcacggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacggcacaggtgcccaggtctcggagagcccctcccaggacatgcacaccaggcttgccctttggagcctctcctgaccttggccagcgtgggagctgctgttcctgggaggatccgccacctgcccaggcgctcaccagcctggcttccacagctgctacccacagggctgcggggcctgcatggcgtggcgagggtccggatggttcngtgcccggccatctggctgcctggcacctctggagctnncncanttcactgatccgcgcncaagggcaattgcgcaggtcatgcagcggccggcgttgtcgactgaagctgcactgtggtgccaggtccggtcggggaggcgcagcccggttagggccaacactgatacggggcaggacatttggccaagacgggtgaaaccggtcgggaaagggagaacggtacggggaggacgcg

SEQ ID NO: 353184 - DNA, 2019 bp, Homo sapiens
  misc_feature (1539)..(1539): n is a, c, g, or t
  misc_feature (1880)..(1880): n is a, c, g, or t
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctcaaaaaaaaaaaaaanaaaaaaaaaaaaaaaaaaaaaggggggggggctaagattttccctgggggggcccttttttgtcccgccagcttttttttgttgacaagaatggtggccccctaatgtgggaggagcctgtatatatataaaagcggagaaaggcgggagcgggagttttgaaacagagtgccagattgggggaaacaaggtggtatacctcgtgggtacactctttgttggaagagagaacccttatatgttgtggtggggggtggagaacacatatattgttgggggacaacacatttatgcctctatacatgggcagatatgttacagaagggcgctctaagaggtgngcatgatattataaatgttttatagtaagggtggtatatataggtgtgtgtgtgtaagacctcggaggtgctggataatgtgtggtatggctggggtgtaggataaaagttttgaggtgattagcgggaggttatatat

SEQ ID NO: 353185 - DNA, 1745 bp, Homo sapiens
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccaggtagggccgggggactggagtccaggtggggccgggtcgggggcagcctgcggaggacccgggacacctccagggaggtctgcgtgcgcgcggggtctggccctaagggctggacgggggtggggggcgacgtggggcgtggcttgtggaggggcgggtcagggggggaaagggccccaccgaggggctttcgccgctcagctcccccgccccgtccccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctc

SEQ ID NO: 353186 - DNA, 958 bp, Homo sapiens
aataaatgtgctctgagggtcccagtccccactctttaggccacagactgtggggatgtgggaggtcagatttaagctattttagtgcaaccaaaggtgcaggttgggggatgtggctggggcgcctgggccctgggacccgcaccctgtgcagccgaggctgttgcccgcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctc

SEQ ID NO: 353187 - DNA, 1182 bp, Homo sapiens
  misc_feature (945)..(945): n is a, c, g, or t
  misc_feature (983)..(984): n is a, c, g, or t
  misc_feature (986)..(986): n is a, c, g, or t
  misc_feature (989)..(989): n is a, c, g, or t
  misc_feature (1005)..(1005): n is a, c, g, or t
ggcacgaggaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccagtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacggcacaggtgcccaggtctcggagagcccctcccaggacatgcacaccaggcttgccctttggagcctctcctgaccttggccagcgtgggagctgctgttcctgggaggatccgccacctgcccaggcgctcaccagcctggcttccacagctgctacccacagggctgcggggcctgcatggcgtggcgagggtccggatggttcngtgcccggccatctggctgcctggcacctctggagctnncncanttcactgatccgcgcncaagggcaattgcgcaggtcatgcagcggccggcgttgtcgactgaagctgcactgtggtgccaggtccggtcggggaggcgcagcccggttagggccaacactgatacggggcaggacatttggccaagacgggtgaaaccggtcgggaaagggagaacggtacggggaggacgcg

SEQ ID NO: 353188 - DNA, 589 bp, Homo sapiens
gccttctctgcagaggggccctggccaccacaggccagtctggaggtccccagctttgggggctggccacagtccagacgcccctccctcgcctcccccatacccacttctaccctctctgtctggctctaggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctc

SEQ ID NO: 353189 - DNA, 491 bp, Homo sapiens
agctcctaggtttaattttagaacacagggtccatagtgaggtaggagatagaggaaaataataaaaggggtccatggaagtgaaacagttaggaagcaatatttgagaaaagctcagcatttgctgattagagaactgtagtttgtttcctttttagtactattaaaagtcatgatccttaataatccttaattgctaatgtcagatggagtaatgatatgggctttcaggattcaacgtttcctaacatcaacttcagagtttacaaatatttgccgtgatgaataagtagagctgtgcctaaagaaaagtaggcagaacttgaggctgaaggtaaagagactgcttaggaagtcaaaacaaaatctaagcaaaagataaagtctaaacgtaaggtgtggcagcaggaatggaaaaggaaagacattataatgtggatgtaaaatgaatcaaatatctaggtctcaaactttggagtaaaggaggttac

SEQ ID NO: 353190 - DNA, 637 bp, Homo sapiens
cctgtatcttttagcaattacttgaagaaataccataatactatatgtggaagacatcccattggggtgttattaaatgctataatggaatgaatatgagtttttcgtttttgaattatgcccagtcgagccagtgtagaaactggcaagacagttcagtgagttatggtccactgaagctctgaatcctcagggatgccacctgcacattctcatactctgtccggggtcccagcctagcctttaccacgatagggattctgaaacctcaaactaatagaactttcttctctttttttctagtaggtgtagtccttccttaatttcaactcattaaaaaatgtggaaggaaggctggcatcaaaatattttgatcaaaaaagatgacaatgtaaaggctcagttgtggcagacagttttttgaaagtaacttctaaatttgcactctttgcagacttgtgcacatatattccgctttcagaatagttttgcaaattgtacacaaacaaacaaaaaggtggaagctttttaataaagaaattgcaatataataaatctccagttatagtcaattactacccatgttgtacaacagataccttctattttagttgctaataaagggctacacaactca

SEQ ID NO: 353191 - DNA, 678 bp, Homo sapiens
cctgtatcttttagcaattacttgaagaaataccataatactatatgtggaagacatcccattggggtgttattaaatgctataatggaatgaatatgagtttttcgtttttgaattatgcccagtcgagccagtgtagaaactggcaagacagttcagtgagttatggtccactgaagctctgaatcctcagggatgccacctgcacattctcatactctgtccggggtcccagcctagcctttaccacgatagggattctgaaacctcaaactaatagaactttcttctctttttttctagtaggtgtagtccttccttaatttcaactcattaaaaaatgtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactca

SEQ ID NO: 353192 - DNA, 978 bp, Homo sapiens
cctgtatcttttagcaattacttgaagaaataccataatactatatgtggaagacatcccattggggtgttattaaatgctataatggaatgaatatgagtttttcgtttttgaattatgcccagtcgagccagtgtagaaactggcaagacagttcagtgagttatggtccactgaagctctgaatcctcagggatgccacctgcacattctcatactctgtccggggtcccagcctagcctttaccacgatagggattctgaaacctcaaactaatagaactttcttctctttttttctagtaggtgtagtccttccttaatttcaactcattaaaaaatgtggaaggaaggctggcatcaaaatattttgatcaaaaaagatgacaatgtaaaggctcagttgtggcagacagttttttgaaagtaacttctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaataaataaataaataaataatttaaaaaataaataaaaataaactgaatgaaattgaaaacatatcaatgtgagatgccactaaagtcatactaaaagggaatttacaccacttactgcctacattagaaaagaagtctcaaatcaatgcaaatcaatgacttctgcctttacagtaagaaaccagaaaaagagcaaataaaatccagtaagcagaagaaaggaaacaaagatcagaacagaaattaatataatcaggaaaagagagagagagagaatcattgtaaccagaagtttgaggaaaatcaaatcaattgg

SEQ ID NO: 353193 - DNA, 997 bp, Homo sapiens
cctgtatcttttagcaattacttgaagaaataccataatactatatgtggaagacatcccattggggtgttattaaatgctataatggaatgaatatgagtttttcgtttttgaattatgcccagtcgagccagtgtagaaactggcaagacagttcagtgagttatggtccactgaagctctgaatcctcagggatgccacctgcacattctcatactctgtccggggtcccagcctagcctttaccacgatagggattctgaaacctcaaactaatagaactttcttctctttttttctagtaggtgtagtccttccttaatttcaactcattaaaaaatgtggaaggaaggctggcatcaaaatattttgatcaaaaaagatgacaatgtaaaggctcagttgtggcagacagttttttgaaagtaacttgtaaagcatttaccatatcctaaatttgcactctttgcagacttgtgcacatatattccgctttcagaatagttttgcaaattgtacacaaacaaacaaaaaggtggaagctttttaataaagaaattgcatttataaatgatctgtattagaatataataaatctccagttatagtcaattactacccatgttgtacaacagataccttctattttagttgctaataaagggctacacaactcaaaataaataaataaataaataatttaaaaaataaataaaaataaactgaatgaaattgaaaacatatcaatgtgagatgccactaaagtcatactaaaagggaatttacaccacttactgcctacattagaaaagaagtctcaaatcaatgcaaatcaatgacttctgcctttacagtaagaaaccagaaaaagagcaaataaaatccagtaagcagaagaaaggaaacaaagatcagaacagaaattaatataatcaggaaaagagagagagagagaatcattgtaaccagaagtttgaggaaaatcaaatcaattgg

SEQ ID NO: 353194 - DNA, 132 bp, Homo sapiens
gggtcccagcctagcctttaccacgatactggtcctggtttggggggattctgaaacctcaaactaatagaactttcttctctttttttctagtaggtgtagtccttccttaatttcaactcattaaaaaat

SEQ ID NO: 353195 - DNA, 458 bp, Homo sapiens
gtgatccacctgcctcagcctctcaaagtgctgggattacaggcgtgagccactgcgcctggctgaaagtagggtttttgctttgtctttttccaccatcttgcatcagaaactctttctcattattattctgtgttaaaatgaaataatcagcgtatacaaaagaatatatataatatttattataactcataataatatataataataagacatagacctgtgagttggctcctaacttatcaccaagacaagaccagtactgttgaggtcacggcatgttccttccggatcccatctctttgcctcccctcatgcccaggaaacagctcctcttgggtattttctgttcatctttctcttgattctcccctccattattttttcaccaaatttttctttttctttctgtcttttttttaaaattgtttaattttttttttattttgagacagaat

SEQ ID NO: 353196 - DNA, 378 bp, Homo sapiens
gtgtttttcaacatgactgactcgctagagggaggcctttcaaacaacagagacctccatttccagcccaaattcctatcctaaaacgtacagtcgccgagcatggtggctcacgcgtgtaatcccagcactctggaaggccaaggcaggcagatcacctgaggtcaggagttcaagaccagcctggctaacatggtgaaaccccgtctctactaaaaatacaaaaaactagctgggcgtggtggcacatgcctgtaatcccagctactcgggaggctgaggcaggagaatcacttgaactggagaggtggaagttgcagtaagccgagatcatgccaccgcactctagcctgggcaacaagagcaaactccatgtca

SEQ ID NO: 353197 - DNA, 428 bp, Homo sapiens
cttggattctccattaaggtggcatcctctcaaacccatggggtatcctggcatcttccttgctgagtttgtcctgcaaacccctggggtcctcaggtttggggcttgagtgtccctgtgctccacaattctctctctctcttttttttttttttttttgatggagtctcactctgttgcccaggctggagggcagttgtgcgatcccagctcactgcaacctccacctcctgggtttgagcgattctccagcctcagcctcccgaatagttggaattacaggcgcccaccaccacgcccagctaatttttgtatttttagtagagacggggtttcatcgtgttggccaggctggtctcagactcctggcctctggttatctgctcgcctcagcctcccaaagtgttgggattacaggcgtgagccac

SEQ ID NO: 353198 - DNA, 1495 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353199 - DNA, 165 bp, Homo sapiens
gaaaaggggaagggaggcaggaagtaaaactgtggagaggagaggagagtaaggtgtggagaggaagggtggaacagctcttcccaggcaagcaggatgtgtggggagcagatgcctcaaccaaactgcctcctccccctagttcccagtaattccttcctttca

SEQ ID NO: 353200 - DNA, 1743 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccaaaaaaaaaaaaaaaaaaaaaaaacaaaaaaaaataaaaaaaaaaaaaaaaaaaccgcgcgagagagactctattaccggggggcggaaaaaagaggagctaagaaaggcgccatggcgcaataagtttctctgcacccactttttttttaacagggggaaaaaccggggggccccccataaggagggcaataaaattacaaacccccggtaccctgtattgtctcacaacaaccccaaaaataacacg

SEQ ID NO: 353201 - DNA, 2123 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccaaaaaaaaaaaaaaaaaaaaaaaactcgaccccggtaaaaaagcttgccagggcgggatagggctcccgggatatgttgcggcctggggtcacgatccagggattgtagggtctcatgggtccagggaccacgtgagagctcctgggagatagttccactctacttggtgtacacacgggtacccctgcaagggattgtgggcgctgactgggaggggcggcacggacgcacgggatacactcccaggggagggggccacaaattccgggccaatggcatctggcaagggctcgggatcaaaaacttcatttcccccattatcccaacaaaattccagggataagggggagggctcccattcgggacttcacctcaccaagggattaaagggccagagtgcaacggtaacgtcggaccctggcgtgtgcgcgctcgggacgggtctacgagcacagcgggcggggtccacagagagtcctcatcacatccataagccaggaaccccccaatatcaactcccacaatgaagtggtgcggccaaaaagaactctggcgcagcacgggggtggtcctcacatcaccgtggcgcaacgagggtcactaatttccagaagatactaagggaagg

SEQ ID NO: 353202 - DNA, 1689 bp, Homo sapiens
ggtcagaggaggtttctggctcagaatctaggaccttagctcatcaggctggtcccacgtgggtgggtgggtggcgagtctggggctttacttggctttcccaatcctggtgggtcctgctcccccaggcactgacctgtggcccggacccaccctccaccccctgcacagtacagcaggggcgggcagagggcggggctgctgccagatctagtcagacaggtggagccgccggggcaggagtctcaaagagccaggctccaggagaggaagggctctgcgagaggagagaggagagcgctggagaggagaggctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353203 - DNA, 1586 bp, Homo sapiens
cccgggccttcctccaccacccctgcatttacctctctccctcctcctctcccctccctccccccgctaccctaactttgccaggcaccttttcccttccatccatcttaaaggaaggaagggacgggctgagttccccgacgagagacacacccagattttcctgcagcttggggagaggtcctcccaggagccttggtccctcctggcctgccggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353204 - DNA, 1562 bp, Homo sapiens
  misc_feature (106)..(106): n is a, c, g, or t
tcatcatgcacgatcgagagacagctggcgagcgcatggcacgtgcatgtgccctcgagagggacattctcgtcatcggtcccgtgtcgtccactcgcgctggcgnacatcctgcctgtatgtcccagtccttgggtccaccatatcggaagctcgcattacgcctagggcattaggagagcgtgcttgatgatactctgatagccacatgagagtgattgacagcacgcatgattctccacggattccatggatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353205 - DNA, 1570 bp, Homo sapiens
ctgacctcatgtctgtagacccttcaaatgaagacccttcgaaccctgtgactcttcctgattcctttgacccttattcatagaatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgaggtgggcccctgggatgccgggctttaatttctgtcagcaggataaggagcaggccatagagccagagcatggcatttctcctttccagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353206 - DNA, 1395 bp, Homo sapiens
cccgggccttcctccaccacccctgcatttacctctctccctcctcctctcccctccctccccccgctaccctaactttgccaggcaccttttcccttccatccatcttaaaggaaggaagggacgggctgagttccccgacgagagacacacccagattttcctgcagcttggggagaggtcctcccaggagccttggtccctcctggcctgccggagtccttagccaggatggaggctgttgtgaacttgtaccaagaggtgatgaagcacgcagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353207 - DNA, 1437 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcactgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353208 - DNA, 1414 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353209 - DNA, 1422 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353210 - DNA, 1170 bp, Homo sapiens
  misc_feature (896)..(896): n is a, c, g, or t
  misc_feature (898)..(899): n is a, c, g, or t
  misc_feature (902)..(902): n is a, c, g, or t
  misc_feature (908)..(908): n is a, c, g, or t
  misc_feature (983)..(983): n is a, c, g, or t
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtancnngangaatgngctctttccatgccatgataaactcttccgtgcatgtcataatgtacctgtactacggattatctgcctttggcnctgttggcccagccttacctttggtggcacaaacgccatgacagcgattcaggtgatccagtttggtcctggtcctccactgcccctttacggcagtggtcccgtccgttgccttctctcactaaaacctggtgaaccaggcttatggggtccggacctgagccgggagcttggccttcccttacca

SEQ ID NO: 353211 - DNA, 918 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353212 - DNA, 537 bp, Homo sapiens
gaaatcttggagaagggtctaaaggtgcgggagtatgagttaagaaaaaacaacttctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353213 - DNA, 948 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgaggtgggcccctgggatgccgggctttaatttctgtcagcaggataaggagcaggccatagagccagagcatggcatttctcctttccagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacagtgagtagttatatgagatgtgagaacttgaggggagaatgaggtggagaagcccaggttctgaatccccttccctcactcttctctcaggtgatctttattctccgaaagaaagacgggcaggtgaccttcctacatgtcttccatcactctgtgcttccctggagctggtggtggggggtaaagattgccccgggtgagtggtgaaggccactatgggaaagggtgggctacagaggctgactctgcagaccct

SEQ ID NO: 353214 - DNA, 722 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgaggtgggcccctgggatgccgggctttaatttctgtcagcaggataaggagcaggccatagagccagagcatggcatttctcctttccagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacaatgttcaggtaccagctcggttcgtatcag

SEQ ID NO: 353215 - DNA, 616 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatactggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353216 - DNA, 430 bp, Homo sapiens
gaaaaggggaagggaggcaggaagtaaaactgtggagaggagaggagagtaaggtgtggagaggaagggtggaacagctcttcccaggcaagcaggatgtgtggggagcagatgcctcaaccaaactgcctcctccccctagttcccagtaattccttcctttcactgttctgtcctttctgcaatgaggcattgcaggtgtcttgtctggttctgtgtcttatctctgtgggatgggggtgtgcagtgggatctgtctgacatccgccctctgtacctccccagagtccttagccaggatggaggctgttgtgaacttgtaccaagaggtgatgaagcacgcaggtaagacgctatccaccagccctttccttccttctttcccgggatccctggatctacggctgtcttctaatggagagttcctatg

SEQ ID NO: 353217 - DNA, 394 bp, Homo sapiens
caaccctacctttggtggaaaaagcacatgacagccattcagctggtgaggggcttggcctgacttacctataaccatccccccacattcctagcctggatcctgcctttatccagtctgtctcacctttgaccccatctctccctactcaacgtttgtctctttctctaccccctcttcccctctagtcctctcactattccctctgaccctggtctttctctatcctagatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggc

SEQ ID NO: 353218 - DNA, 1583 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacggaggctgtgtgtatacgtatgtgaacagaggaggtgggggaacacaacacgcttagccctgtccacaaacaagagggatggatggt

SEQ ID NO: 353219 - DNA, 1423 bp, Homo sapiens
ccgcaggcttggggcctgaccacggtgggcctaaagaagccgggcctcctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353220 - DNA, 1672 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgaggtgggcccctgggatgccgggctttaatttctgtcagcaggataaggagcaggccatagagccagagcatggcatttctcctttccagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353221 - DNA, 1778 bp, Homo sapiens
ggtcagaggaggtttctggctcagaatctaggaccttagctcatcaggctggtcccacgtgggtgggtgggtggcgagtctggggctttacttggctttcccaatcctggtgggtcctgctcccccaggcactgacctgtggcccggacccaccctccaccccctgcacagtacagcaggggcgggcagagggcggggctgctgccagatctagtcagacaggtggagccgccggggcaggagtctcaaagagccaggctccaggagaggaagggctctgcgagaggagagaggagagcgctggagaggagaggctggagagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353222 - DNA, 1334 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcactcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353223 - DNA, 1762 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgaggtgggcccctgggatgccgggctttaatttctgtcagcaggataaggagcaggccatagagccagagcatggcatttctcctttccagagaggttcagatccatgtcctcagctagcgaaggggagggatggctgggaagggagaactctggtggtctaatccacatcccttcccagttcctgatgtcgggctggctgagcacctatacctggcgctgtgaccctgtggactattccaacagccctgaggcacttaggatggttcgggtggcctggctcttcctcttctccaagttcattgagctgatggacacagtgagtagttatatgagatgtgagaacttgaggggagaatgaggtggagaagcccaggttctgaatccccttccctcactcttctctcaggtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353224 - DNA, 1291 bp, Homo sapiens
  misc_feature (1017)..(1017): n is a, c, g, or t
  misc_feature (1019)..(1020): n is a, c, g, or t
  misc_feature (1023)..(1023): n is a, c, g, or t
  misc_feature (1029)..(1029): n is a, c, g, or t
  misc_feature (1104)..(1104): n is a, c, g, or t
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtaattgagctgatggacacagtgatctttattctccgaaagaaagacgggcaggtgaccttcctacatgtcttccatcactctgtgcttccctggagctggtggtggggggtaaagattggccncnngangaatgngctctttccatgccatgataaactcttccgtgcatgtcataatgtacctgtactacggattatctgcctttggcnctgttggcccagccttacctttggtggcacaaacgccatgacagcgattcaggtgatccagtttggtcctggtcctccactgcccctttacggcagtggtcccgtccgttgccttctctcactaaaacctggtgaaccaggcttatggggtccggacctgagccgggagcttggccttcccttacca

SEQ ID NO: 353225 - DNA, 685 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353226 - DNA, 634 bp, Homo sapiens
cccctctggtgacagaaagtcggcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacca

SEQ ID NO: 353227 - DNA, 1186 bp, Homo sapiens
ttgctatctttatttctttatttgcactgggaaataacatctttgtctactatttctagcatctgagatccaggtcagttgtgattaatttttctctgtattatgcaatgtattttcctgcttttcatgcctctctactggatgctagacattgtacattttaccttcttgggcactgaatatttttgtagtcccagaggtacttttgagctttgtcctaggatgcagtgtgatcctttcaggtcctgctgtatagctgtgtcaggtggcagtgcccatctagggtttctcacttgtgttttctacccagtgccccataaatcatgaggttttccagctagggtggtgggaacaggccctaccctaggtcctgtgtcagcaccactgttccttctaatcttctcacatggctctttctctggcctgaggtggttccttacacacatgcgctgatcagtagggctgtgctgcctagttgagggagctccctctggcccccgacttagatctgtgtgtctctctccagtactgtgaccgcgagttccggccaccttagtctccctggatccctggcattgttttcctactgcagggaggctggcaggctccacctgggttccccccgcatgcacactgcagctgggaccctcctcggagcatgagctggacaatcacagggctcccctcctgagtttgccctctcaagaatcactatccttcactccctggtatttggtggcttgcaaaccgttgtttcacatattttgtccattgtttgcttgtttcatgcaggagggaaaagtccagtacctgtttctccatcttagccatatgagactcttaaattattatttttttcctttcctagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacaggtatccttaatgactattccttttctttttttgcaaatctgcactaggtatagatttagatcggatccatttgaaattatattttgaggagcacagagcagagatagtgatcaactcatttaacct

SEQ ID NO: 353228 - DNA, 3074 bp, Homo sapiens
caggcagagagcacgaggcccagtgcagaatcattttctgaaccagccaggaaataccggaacccaccaaactttaaacaccagcctaaattattcctgttcttttaagcaggcagcagaaatgacagaaacccgttaacagaaaaaaaaaaaataatgcttttcatttgaactcctgtgcattttctttttaacttatatgtgttcctaattttccttactctttttgtttgtttgtttcttagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattacgactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaa

SEQ ID NO: 353229 - DNA, 3375 bp, Homo sapiens
actgagcgagggtagcggccaggtcaccggctgaggacactgctcctgaagcccggtcaggcggtcgcgccctccctggcggcccccgcggcccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcagcttcgtagatcagaagtcggttgtcggtctcactggactacaatcaaggtgccagcaggactgtgttcgtttctggaaattctagaagatgatctgtttccttgcctcttctagctcctagaggtcactcacatcattcttcggccgtggccccttcctccaccttcaaagcccacaacattgcatctctccgaccttcttccatagtcatattttcctctgactgtggctaggagggtcctctgattgttaagactcatgtaattagattgggctcaccaggatcgtccaggataatcttccaatctcaagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattacgactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaa

SEQ ID NO: 353230 - DNA, 2099 bp, Homo sapiens
ttgctatctttatttctttatttgcactgggaaataacatctttgtctactatttctagcatctgagatccaggtcagttgtgattaatttttctctgtattatgcaatgtattttcctgcttttcatgcctctctactggatgctagacattgtacattttaccttcttgggcactgaatatttttgtagtcccagaggtacttttgagctttgtcctaggatgcagtgtgatcctttcaggtcctgctgtatagctgtgtcaggtggcagtgcccatctagggtttctcacttgtgttttctacccagtgccccataaatcatgaggttttccagctagggtggtgggaacaggccctaccctaggtcctgtgtcagcaccactgttccttctaatcttctcacatggctctttctctggcctgaggtggttccttacacacatgcgctgatcagtagggctgtgctgcctagttgagggagctccctctggcccccgacttagatctgtgtgtctctctccagtactgtgaccgcgagttccggccaccttagtctccctggatccctggcattgttttcctactgcagggaggctggcaggctccacctgggttccccccgcatgcacactgcagctgggaccctcctcggagcatgagctggacaatcacagggctcccctcctgagtttgccctctcaagaatcactatccttcactccctggtatttggtggcttgcaaaccgttgtttcacatattttgtccattgtttgcttgtttcatgcaggagggaaaagtccagtacctgtttctccatcttagccatatgagactcttaaattattatttttttcctttcctagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattacgactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaa

SEQ ID NO: 353231 - DNA, 2820 bp, Homo sapiens
actgagcgagggtagcggccaggtcaccggctgaggacactgctcctgaagcccggtcaggcggtcgcgccctccctggcggcccccgcggcccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattacgactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaa

SEQ ID NO: 353232 - DNA, 2393 bp, Homo sapiens
ttttgttctcattattccaattggcaagttttcactcattaggatcaacagccatgctgtttgcttggtaaaaaatctgccccaagtaattcaattatatgtggaaaaaggaagtgcaagcaagggaccgtacctgtgtaccagctgatgtgggaccccctggagcggcctctgcccagcttcctgggagccacttagcagaccaggaaacgagcacagctcacctagttctcagtgacctgtgataccttgctatttttctagatggatctgtcttcctacaaaacccttgagttaattcaatcccattctacaaatggtatggaaaggaaagagacataagctagagacctagagaatggaattgagctgtaaaaactatggcagttgtgggaagtcatcttttttacttagatttttagtgaaatctaacaaaattaaatgggaaaacaatataaattatatttaacttccccaaagacgttttctcatttaggtgcatctttacttatttaaagatacatgtaggcagcaacacagggatttctttccctgtatctgttacgtagtattgcctaaaattttttgtaattcagacatttttttaatagtgatgttgtttgcattgtattttattttcatgggtttttttttctttaggatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattacgactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaa

SEQ ID NO: 353233 - DNA, 1979 bp, Homo sapiens
actgagcgagggtagcggccaggtcaccggctgaggacactgctcctgaagcccggtcaggcggtcgcgccctccctggcggcccccgcggcccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccaggtagccttatgctcccatgtcagccaggcattaggctgagattcaccttctcctgcccattctctgtcctgagttcacatgatgcgcagcaatgcacacaagcatggagggggcgttggtttggactgaagcattttcctgctagag

SEQ ID NO: 353234 - DNA, 1179 bp, Homo sapiens
actgagcgagggtagcggccaggtcaccggctgaggacactgctcctgaagcccggtcaggcggtcgcgccctccctggcggcccccgcggcccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaacgcccgtaagtgaccacgcaaacgcc

SEQ ID NO: 353235 - DNA, 330 bp, Homo sapiens
ttggctgcataaaaaacagaaagtatttattttacaaagtcggactgagatactatctgagttcaaattaaataccggttctacaggtagattctccagggatgggaagtgcccagacataatgtttggtgtctctcaccaccttccccactcataatctcatctttttgtcttaaataaacagatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactg

SEQ ID NO: 353236 - DNA, 3063 bp, Homo sapiens
actgagcgagggtagcggccaggtcaccggctgaggacactgctcctgaagcccggtcaggcggtcgcgccctccctggcggcccccgcggcccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattacgactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaa

SEQ ID NO: 353237 - DNA, 2890 bp, Homo sapiens
actgagcgagggtagcggccaggtcaccggctgaggacactgctcctgaagcccggtcaggcggtcgcgccctccctggcggcccccgcggcccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttcttta

SEQ ID NO: 353238 - DNA, 2361 bp, Homo sapiens
  misc_feature (2361)..(2361): n is a, c, g, or t
ttgctatctttatttctttatttgcactgggaaataacatctttgtctactatttctagcatctgagatccaggtcagttgtgattaatttttctctgtattatgcaatgtattttcctgcttttcatgcctctctactggatgctagacattgtacattttaccttcttgggcactgaatatttttgtagtcccagaggtacttttgagctttgtcctaggatgcagtgtgatcctttcaggtcctgctgtatagctgtgtcaggtggcagtgcccatctagggtttctcacttgtgttttctacccagtgccccataaatcatgaggttttccagctagggtggtgggaacaggccctaccctaggtcctgtgtcagcaccactgttccttctaatcttctcacatggctctttctctggcctgaggtggttccttacacacatgcgctgatcagtagggctgtgctgcctagttgagggagctccctctggcccccgacttagatctgtgtgtctctctccagtactgtgaccgcgagttccggccaccttagtctccctggatccctggcattgttttcctactgcagggaggctggcaggctccacctgggttccccccgcatgcacactgcagctgggaccctcctcggagcatgagctggacaatcacagggctcccctcctgagtttgccctctcaagaatcactatccttcactccctggtatttggtggcttgcaaaccgttgtttcacatattttgtccattgtttgcttgtttcatgcaggagggaaaagtccagtacctgtttctccatcttagccatatgagactcttaaattattatttttttcctttcctagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattacgactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaaaaaaaaaaaaaaaaaaaaaaaaaaaaaaagggggggggcgtaaaagattaattccccgcgaagagggggcgccccaacgagctattaacgcggtgtacaccacagaggtatttcctcgggcgaccacagaggggggggcgcccctaaaatagaggggagggcgcaggtaaatatcaatagagggcaagagggagccgatgcggggggcccggcgggggtttcaaccaacagcggtctgcagagagcgctggggggagaatcn

SEQ ID NO: 353239 - DNA, 1854 bp, Homo sapiens
ttgctatctttatttctttatttgcactgggaaataacatctttgtctactatttctagcatctgagatccaggtcagttgtgattaatttttctctgtattatgcaatgtattttcctgcttttcatgcctctctactggatgctagacattgtacattttaccttcttgggcactgaatatttttgtagtcccagaggtacttttgagctttgtcctaggatgcagtgtgatcctttcaggtcctgctgtatagctgtgtcaggtggcagtgcccatctagggtttctcacttgtgttttctacccagtgccccataaatcatgaggttttccagctagggtggtgggaacaggccctaccctaggtcctgtgtcagcaccactgttccttctaatcttctcacatggctctttctctggcctgaggtggttccttacacacatgcgctgatcagtagggctgtgctgcctagttgagggagctccctctggcccccgacttagatctgtgtgtctctctccagtactgtgaccgcgagttccggccaccttagtctccctggatccctggcattgttttcctactgcagggaggctggcaggctccacctgggttccccccgcatgcacactgcagctgggaccctcctcggagcatgagctggacaatcacagggctcccctcctgagtttgccctctcaagaatcactatccttcactccctggtatttggtggcttgcaaaccgttgtttcacatattttgtccattgtttgcttgtttcatgcaggagggaaaagtccagtacctgtttctccatcttagccatatgagactcttaaattattatttttttcctttcctagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcggccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagagtctccgtcgaactagcggagagtctccgtcgaa

SEQ ID NO: 353240 - DNA, 539 bp, Homo sapiens
taggaaatgtgcaacgtctatatgaatgaaaaaacccatagaactttgcttaaggatataaatgaagagctgagtgaatgtagaattaccatgttcctagacagaagatgcaaaaagtaaatgtcaattctcaatctatattatttcatgcaattttaatcaaaagcccaataattttgtgaattgtaatcccaaaggattaaacctaaaaaatccacagctaagctaaaaaactaaagaatataaaaatattttctaagcaagacaagatacccaaaagccataaatgtaaaagatcaacagatatgattgcctaaaactaaaaatcttcaagcaatacaagactcaaacacaaacctaaaatctagggagaaagggtcaatatgcttccattaaaaaaatccatacgtggccaggcgcggtggctcacgcctgtaatcccagcactttgggaggcggaggcaggcagatcacaaggtcaggagatcgagaccatcctggctaacatggtgaaaccccgtctctactaaaaaaaaaaa

SEQ ID NO: 353241 - DNA, 439 bp, Homo sapiens
ggctcatgcagaagctggagctgggccggtacaatgagacacacgccatagccaagtggctactagagaagcaggagctgggaggaggcttcaggtccacccagaccacggtggtggcccttgaagctctgacccgcttccgcgaagctgtccccttcaagggcatccaggatctccacgtccagatcagagcccccaagacagccctgaatgtgaattggtacattgatcacagcaatgcctaccaacagcggtcagcaaagttccttgcccaggacgacctagagatcgccagtggcaacgggagaggcaccatctcgatcctgacaatgtatcacaagtccccagagtcccgggaggacaactgcaacctgtaccacctgaatgcgactctccacagtgccctagaaggtaagcctggtgtggctacaggaggagt

SEQ ID NO: 353242 - DNA, 1302 bp, Homo sapiens
ggctcatgcagaagctggagctgggccggtacaatgagacacacgccatagccaagtggctactagagaagcaggagctgggaggaggcttcaggtccacccagaccacggtggtggcccttgaagctctgacccgcttccgcgaagctgtccccttcaagggcatccaggatctccacgtccagatcagagcccccaagacagccctgaatgtgaattggtacattgatcacagcaatgcctaccaacagcggtcagcaaagttccttgcccaggacgacctagagatcgccagtggcaacgggagaggcaccatctcgatcctgacaatgtatcacaagtccccagagtcccgggaggacaactgcaacctgtaccacctgaatgcgactctccacagtgccctagaagaaaataaaaagggaggtgagacttttcggctccggatggaaacaaggttccagaacaattgagaggccacaatgactatcatggaggtctccctgctcacgggcttctaccccaaccaggatgaccccagctcacgagtgatgtggagaggtacgcctttcagtacaaaaccaagacaagtaccagcgacagcactgttgtcctctacctggtgcaggcggagttcctgcaggccgccctggtcaccatctacgactactacgagccttcccggaggtgcagcactttctacaacctgcccacagagcaatcttccctgagaaagatctgccacaaagacatctgcagatgtgcagagggacagtgcccatccctgcagaagcccagtggccaattgaggcaggaggagctccagacaacagcatgtgaggcaggcgtggattttgtgtacaagacaaagctggaatctgtggaggtctctgcctccaacccttacgtctattacaacacgcagctcgaagacatcattaagagtggtacggaccctgccacacccctggccatgaagaaattcgtctcccatgccacttgccatgactccctggggttgcaagaacaggaatcgtacctcatcatgggccagacgtcagacctgtggagaatcaaatctgattacagctatgttctgggcaaggagacgttcctcatcctttggccagcagatggagatgccagcaagaaagaattgcgggaccaactggaggaatttttggaatatatgcgcacccacggctgccagtcctgagcctcttctgctttcagggaggtgtcatcaggcagctctgggccactgggtttaaccccaaataaagagcacaggatatgacaccc

SEQ ID NO: 353243 - DNA, 739 bp, Homo sapiens
gttctctccagctctcccatgagaagaacacggtgctgggctttcgggttcacaggatgctgcaggcggagttcctgcaggccgccctggtcaccatctacgactactacgagccttcccggaggtgcagcactttctacaacctgcccacagagcaatcttccctgagaaagatctgccacaaagacatctgcagatgtgcagagggacagtgcccatccctgcagaagcccagtggccaattgaggcaggaggagctccagacaacagcatgtgaggcaggcgtggattttgtgtacaagacaaagctggaatctgtggaggtctctgcctccaacccttacgtctattacaacacgcagctcgaagacatcattaagagtggtacggaccctgccacacccctggccatgaagaaattcgtctcccatgccacttgccatgactccctggggttgcaagaacaggaatcgtacctcatcatgggccagacgtcagacctgtggagaatcaaatctgattacagctatgttctgggcaaggagacgttcctcatcctttggccagcagatggagatgccagcaagaaagaattgcgggaccaactggaggaatttttggaatatatgcgcacccacggctgccagtcctgagcctcttctgctttcagggaggtgtcatcaggcagctctgggccactgggtttaaccccaaataaagagcacaggatatgacaccc

SEQ ID NO: 353244 - DNA, 714 bp, Homo sapiens
  misc_feature (22)..(22): n is a, c, g, or t
  misc_feature (51)..(51): n is a, c, g, or t
  misc_feature (92)..(92): n is a, c, g, or t
  misc_feature (110)..(110): n is a, c, g, or t
ctgtctcagcatgagtactagnaagtgcccctgaggtgacagctatgactntgtcccagtcatcctcagacatgtgcagcagaaactcatcntggatgatggcccacagnacacaacgacagatggtgtcctcgtgccgaacggcacccggaggtgcagcactttctacaacctgcccacagagcaatcttccctgagaaagatctgccacaaagacatctgcagatgtgcagagggacagtgcccatccctgcagaagcccagtggcctgtacaagacaaagctggaatctgtggaggtctctgcctccaacccttacgtctattacaacacgcagctcgaagacatcattaagagtggtacggaccctgccacacccctggccatgaagaaattcgtctcccatgccacttgccatgactccctggggttgcaagaacaggaatcgtacctcatcatgggccagacgtcagacctgtggagaatcaaatctgattacagctatgttctgggcaaggagacgttcctcatcctttggccagcagatggagatgccagcaagaaagaattgcgggaccaactggaggaatttttggaatatatgcgcacccacggctgccagtcctgagcctcttctgctttcagggaggtgtcatcaggcagctctgggccactgggtttaaccccaaataaagagcacaggatatgacaccc

SEQ ID NO: 353245 - DNA, 2531 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgcaaaaaaaaaaaaaataacaacaaaaaggggggggcggcaaaaaattccccgggggggcgccagttacgggccccagtttttgttgaaaagggggcccaaaggggggcg

SEQ ID NO: 353246 - DNA, 2603 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccaggtgagtgaggcagcctggtgagtgaagagaactctctgtgggattggtatttctagctcacccacctggtctctccttccaggtgtttgagggtgtcaggggagtttcaggagagcagaagtttcctttcaggggtgagagggcagtcactgagctgcaaatcctttgaaatgtttcagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353247 - DNA, 2561 bp, Homo sapiens
  misc_feature (2427)..(2427): n is a, c, g, or t
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgcaaanaaaaaaaaaaaaaaaaaaaaaaaaaaaaaaaaaaaaaaaataacaacaaaaaggggggggcggcaaaaaattccccgggggggcgccagttacgggccccagtttttgttgaaaagggggcccaaaggggggcg

SEQ ID NO: 353248 - DNA, 2504 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagcctcccgccccgcccattgatctcaggctccacccctctaagcctcttatctttctccttccttcccttccacccgaggaatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353249 - DNA, 2535 bp, Homo sapiens
caagctgcaaagaggcgcgggaaccactgtcgtgcccctcccctcctcactgcagtgttctcccatctcatcatttgatcttaccccgccccccactgcagtgacctccccttcctcactgcattgaccttctcctcttcccaggggggagggggaatcccttctacagccctagactgcagccagcgcctccctacccaccccccacccactgcagtaacctctttcccatccctcccagcctcccgccccgcccattgatctcaggctccacccctctaagcctcttatctttctccttccttcccttccacccgaggaatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353250 - DNA, 2373 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattatttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353251 - DNA, 2334 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaactgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353252 - DNA, 1563 bp, Homo sapiens
ggacgcgtgggtcgacccacgcgtccggccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353253 - DNA, 1559 bp, Homo sapiens
ggtcctcgtttctataagactccttttgcaagtgctccagcctaattctacccaggggtgccaaagagagcggggaacctggaatcatcctcacagttctctcacctctgcccctccacccctgattctctgctcccctcccagatagctttcccctagatgtttcctgacatagaccaaggttggggctgggaagagagtgcccagtgtgagagctggagaatcagtgctgtgtgtggatacaggtgcaagctggcccaggagaatggctggggggtcatggtgagtcatcgctcaggagagactgaggacacattcattgctgacctggtggtggggctgtgcacaggccaggtgagtgaggcagcctggtgagtgaagagaactctctgtgggattggtatttctagctcacccacctggtctctccttccaggtgtttgagggtgtcaggggagtttcaggagagcagaagtttcctttcaggggtgagagggcagtcactgagctgcaaatcctttgaaatgtttcagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353254 - DNA, 1513 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353255 - DNA, 940 bp, Homo sapiens
tgaggattcgtacataaggggctctatggacagaatgatcagcatctctgatgggagcgtcaacgtggatcttctgagttattagagaggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353256 - DNA, 777 bp, Homo sapiens
ctctctccacactggctggatggttcaggataatcctctctccacactggcacaccaaccctgacgctcccatcacagatgctgttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353257 - DNA, 342 bp, Homo sapiens
gtgagtgaggcagcctggtgagtgaagagaactctctgtgggattggtatttctagctcacccacctggtctctccttccaggtgtttgagggtgtcaggggagtttcaggagagcagaagtttcctttcaggggtgagagggcagtcactgagctgcaaatcctttgaaatgtttcagatcaagactggtgccccgtgccgttctgaacgtctggctaaatacaaccagctcatgaggtgagggtccctggggtgggagcccctggcccagatggctaaaggccccatttgcctgccagaccatctgtagcaccaagggcctggataacagtccatttcct

SEQ ID NO: 353258 - DNA, 2424 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353259 - DNA, 920 bp, Homo sapiens
  misc_feature (822)..(822): n is a, c, g, or t
  misc_feature (848)..(848): n is a, c, g, or t
  misc_feature (851)..(851): n is a, c, g, or t
  misc_feature (899)..(899): n is a, c, g, or t
  misc_feature (902)..(902): n is a, c, g, or t
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccccccaaggggaattcctccaagggaacaaatncccgggaaaggaatgccccccaattnttngggggaataaaaggtgggctttgcccccccattttcctggaaaaaacnatnaaaacccttgggaaactt

SEQ ID NO: 353260 - DNA, 2340 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353261 - DNA, 2294 bp, Homo sapiens
gggcggtacggtccggaatttagggatgcgccgcgtcgccaccgcacgacacggcactaccaccggctgagtctgcagtcatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353262 - DNA, 1964 bp, Homo sapiens
gtagctaggtacgaggcctggtgttaatcggccgaggactgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353263 - DNA, 2133 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatgcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353264 - DNA, 1598 bp, Homo sapiens
ggacgcgtgggtcgacccacgcgtccggtggctttgcccccaatatcctggacaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 353265 - DNA, 1620 bp, Homo sapiens
tgcattggaggaaaaacatgttggcttttctcttgacgtgggagaaattgaaaagaaggggaaggggaagaaaagaaggggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 353266 - DNA, 1654 bp, Homo sapiens
acccgcgcgctgcccggtcctgcgctgcccagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggcttccatgcctatggctgttctaaaattgggccaaatatatccatttcagagaggctttttctgtaaagacaacagcatcaactatccgtaccatgacagtaccgtcacatccactgtcctcatcctagtgggggttggcttgcccatttcctctattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 353267 - DNA, 1648 bp, Homo sapiens
acccgcgcgctgcccggtcctgcgctgcccagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgcgtcgtcgcttcgacgacgcattcatgaatggtgtgagttggcca

SEQ ID NO: 353268 - DNA, 1465 bp, Homo sapiens
acccgcgcgctgcccggtcctgcgctgcccagcgggaggggctggaccccgcgttcctcctccctgccggtccccatccttaaagcgagagtctggacgccccgcctgtgggagagagcgccgggatccggacggggagcaaccggggcaggccgtgccggctgaggaggtccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 353269 - DNA, 1806 bp, Homo sapiens
acccgcgcgctgcccggtcctgcgctgcccagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggcttccatgcctatggctgttctaaaattgggccaaatatatccatttcagagaggctttttctgtaaagacaacagcatcaactatccgtaccatgacagtaccgtcacatccactgtcctcatcctagtgggggttggcttgcccatttcctctctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 353270 - DNA, 1039 bp, Homo sapiens
  misc_feature (15)..(15): n is a, c, g, or t
acttagagctactgngactctcttatttaaccaccgctacagattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 353271 - DNA, 1776 bp, Homo sapiens
  misc_feature (1774)..(1774): n is a, c, g, or t
acccgcgcgctgcccggtcctgcgctgcccagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaatccacacttgcaggcatttgtagtcaactgtaatcaaacaggtggtcaataatttaaaatctcacattcctttagctgactctacaagtagaggctggcagcaaacacaatatctctcttgattttggtgattcctaagagaaaagaaagtaaggtttaaactttcaagaccacaanac

SEQ ID NO: 353272 - DNA, 907 bp, Homo sapiens
  misc_feature (905)..(905): n is a, c, g, or t
tgtagaaataactcttttattcagtattggcaaaatgaagctatttgctgaaggcataacaaagcaactcttaatttggaataatctttaaaaaatcccagttagtctctaattttttatatgcttaatctgtacacctcaaagtatatccttttgtttatatttatcttaggatgctgttgatcacaactttgtatgtagtttttaacttgatctaaattataccattaaatattttgcactgtaggctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaatccacacttgcaggcatttgtagtcaactgtaatcaaacaggtggtcaataatttaaaatctcacattcctttagctgactctacaagtagaggctggcagcaaacacaatatctctcttgattttggtgattcctaagagaaaagaaagtaaggtttaaactttcaagaccacaanac

SEQ ID NO: 353273 - DNA, 317 bp, Homo sapiens
gggccaattttgctctcctccttgtggaagtctcttttattgtttatttctaaaatcggaggtcaatgcaagtaatagtatttatacttggaaaaaggtggggctgatatggacaagcaaatgatgctgcatgatttccttaatctttgcccttgggtataatggagatccatctccagagagggcaaaatatggctaggatttgcatcccattcagtagactttacttcctaatgaagtgaattgaatttaatcatgtgtgtctttttttcccttccccaacagcttccatgcctatggctgttctaaaattgggc

SEQ ID NO: 353274 - DNA, 1799 bp, Homo sapiens
  misc_feature (1797)..(1797): n is a, c, g, or t
tgcattggaggaaaaacatgttggcttttctcttgacgtgggagaaattgaaaagaaggggaaggggaagaaaagaaggggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaatccacacttgcaggcatttgtagtcaactgtaatcaaacaggtggtcaataatttaaaatctcacattcctttagctgactctacaagtagaggctggcagcaaacacaatatctctcttgattttggtgattcctaagagaaaagaaagtaaggtttaaactttcaagaccacaanac

SEQ ID NO: 353275 - DNA, 1651 bp, Homo sapiens
acccgcgcgctgcccggtcctgcgctgcccagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 353276 - DNA, 1622 bp, Homo sapiens
  misc_feature (1485)..(1485): n is a, c, g, or t
acccgcgcgctgcccggtcctgcgctgcccagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctantcttaaaaatcaagcctcccaaaaaggccctgttctttttacacgtccgcttgtacactgtgtacgcctgagatggccatacattatttggacacacaaaaaaaaaaggggtacacgcaaacacagtacagcagaat

SEQ ID NO: 353277 - DNA, 1499 bp, Homo sapiens
acccgcgcgctgcccggtcctgcgctgcccagcgggaggggctggaccccgcgttcctcctccctgccggtccccatccttaaagcgagagtctggacgccccgcctgtgggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttgaaaggcagcagggtgcccaggtgaagctggcctgttttctaaaggaaaatgattgccacaaggcaagaggatgcatctttcttcctggtgtacaagcctttaaagacttctgctgctgctatgcctcttggatgcacactttgtgtgtacatagttacctttaactcagtggttatctaatagctctaaactcattaaaaaaactccaagccttccaccaaaacagtgccccacctgtatacatttttattaaaaaaatgtaatgcttatgtataaacatgtatgtaatatgctttctatgaatgatgtttgatttaaatataatacatattaaaatgtatgggagaaccaaa

SEQ ID NO: 353278 - DNA, 1412 bp, Homo sapiens
tgcattggaggaaaaacatgttggcttttctcttgacgtgggagaaattgaaaagaaggggaaggggaagaaaagaaggggagagagcgccgggatccggacggggagcaaccggggcaggccgtgccggctgaggaggtcctgaggctacagagctgccgcggctggcacacgagcgcctcggcactaaccgagtgttcgcgggggctgtgaggggagggccccgggcgccattgctggcggtgggagcgccgcccggtctcagcccgccctcggctgctctcctcctccggctgggaggggccgtagctcggggccgtcgccagccccggcccgggctcgagaatcaagggcctcggccgccgtcccgcagctcagtccatcgcccttgccgggcagcccgggcagagaccatgtttgacaagacgcggctgccgtacgtggccctcgatgtgctctgcgtgttgctggctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttattattcttggagaaaccctgtctgtttactgtaaccttttgcactcaaattcctttatcaggaataactacatagccactatttacaaagccattggaacctttttatttggtgcagctgctagtcagtccctgactgacattgccaagtattcaataggcagactgcggcctcacttcttggatgtttgtgatccagattggtcaaaaatcaactgcagcgatggttacattgaatactacatatgtcgagggaatgcagaaagagttaaggaaggcaggttgtccttctattcaggccactcttcgttttccatgtactgcatgctgtttgtggcactttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgtaagtatacaggtcaacagcctacatcttgatattgctaaacatttagataagtaaatagaaaaaaaaaatccaaaaaatccccagctgaggagaagactatgcagtgggcaagaatctcaatgttattaaaagtcacttcaggatacacaccaggttaaaaactaggttgctctttctaaaacttagtagttttgtaaaatcttagtatttttattgtgaaaggctctggctagaaatagtttttttaggggattatgacttgaaaaaact

SEQ ID NO: 353279 - DNA, 4519 bp, Homo sapiens
ctggaaggtgtctactgtttaggaatgtgagaccaagaggaaggggccagccctgcccatgtgactcactccgggatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacggcccggcctgccccgcacctgagctgccctcgcccccctctgctggctacagccctgcaggacagaagcccgaggctgtcgtgcatgccatgaaggtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacaggggagatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcgtgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgcgttctacgcagcaaggcttcaaagtttcaaactggtttggaactcaaccaggtcctccaaaggaaaccaaggcaggcacaggatgggggcaggctggcttggcaggcagctgtgcggatccacccagagtgccttgggaggcagtggggttggctgtggctgctgtgagctgcagccaggcctctcccgcgtccccagggtctggaaggagggcctctgcacattttataagccacagactgcgaaggcctggagccccaccttccacccataacaaagaaagggatagtttcagaactgcttttatttggataactgactgaaggagtctcatttgtaaccaagatggaattcacagtatgttgttacattcacacttaaaaaatatatctctatgtacaggaatttgcaaagagatgtaaacatacattaatttccaagtacatttctccccttctccctggaggaaaaaaaaaaagccatccaatgaggcaaccccttcaaaataattttaatacaaaggatgcaaacatcta

SEQ ID NO: 353280 - DNA, 3763 bp, Homo sapiens
  misc_feature (3655)..(3655): n is a, c, g, or t
ctggaaggtgtctactgtttaggaatgtgagaccaagaggaaggggccagccctgcccatgtgactcactccgggatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacgtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacaggggagatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcgtgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttggtggcaaanaaaggggggccccggtgccccaaattggcctatatgggaggcgtattaccaaatcaattgcccggggttttacaacggcggggactgtggcaccctggggttcccctt

SEQ ID NO: 353281 - DNA, 4423 bp, Homo sapiens
ctggaaggtgtctactgtttaggaatgtgagaccaagaggaaggggccagccctgcccatgtgactcactccgggatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacgtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacaggggagatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcgtgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgcgttctacgcagcaaggcttcaaagtttcaaactggtttggaactcaaccaggtcctccaaaggaaaccaaggcaggcacaggatgggggcaggctggcttggcaggcagctgtgcggatccacccagagtgccttgggaggcagtggggttggctgtggctgctgtgagctgcagccaggcctctcccgcgtccccagggtctggaaggagggcctctgcacattttataagccacagactgcgaaggcctggagccccaccttccacccataacaaagaaagggatagtttcagaactgcttttatttggataactgactgaaggagtctcatttgtaaccaagatggaattcacagtatgttgttacattcacacttaaaaaatatatctctatgtacaggaatttgcaaagagatgtaaacatacattaatttccaagtacatttctccccttctccctggaggaaaaaaaaaaagccatccaatgaggcaaccccttcaaaataattttaatacaaaggatgcaaacatcta

SEQ ID NO: 353282 - DNA, 4308 bp, Homo sapiens
ctggaaggtgtctactgtttaggaatgtgagaccaagaggaaggggccagccctgcccatgtgactcactccgggatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacgtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacaggggagatcccacagctgcagcacggggacaggccgcttccccacatccgctcatgccactgtaagcagccctagctcttgggtccaggacctcaccaggtcctcgtcagactcctgtgctcttccaggggctgctcagccccacctgaagagcccagagaggctgtcttcctacccagcaggtctcatgcaggcccagggctggggatgcaggcaagaggagggagatggccgccctgtccctctccctagctggcggctctattctgagcagttcttgctgcccgtttgctctcaggggaaaggctcacgccccccatcttagccccaggggggtaagtgggtgctggtgatgggatggtgtggcgctcctgccgtgggtgttgccaggaggctctttgggaaggagtgtcgcccggtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcgtgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgcgttctacgcagcaaggcttcaaagtttcaaactggtttggaactcaaccaggtcctccaaaggaaaccaaggcaggcacaggatgggggcaggctggcttggcaggcagctgtgcggatccacccagagtgccttgggaggcagtggggttggctgtggctgctgtgagctgcagccaggcctctcccgcgtccccagggtctggaaggagggcctctgcacattttataagccacagactgcgaaggcctggagccccaccttccacccataacaaagaaagggatagtttcagaactgcttttatttggataactgactgaaggagtctcatttgtaaccaagatggaattcacagtatgttgttacattcacacttaaaaaatatatctctatgtacaggaatttgcaaagagatgtaaacatacattaatttccaagtacatttctccccttctccctggaggaaaaaaaaaaagccatccaatgaggcaaccccttcaaaataattttaatacaaaggatgcaaacatcta

SEQ ID NO: 353283 - DNA, 2805 bp, Homo sapiens
ctggaaggtgtctactgtttaggaatgtgagaccaagaggaaggggccagccctgcccatgtgactcactccgggatccctcatccacctacatcaggcaactggagagcaaagtgaggctgctggagggtgacaagctcctcgcacagcaggcaggctccggagagttccgcacgctgcggaaaggcttctcgccctaccactcggagtcccagcttgcgtccctgccgccctcctaccaggactccctgcagaacgtcctggaggtacacgagaatctggaccggcagctccaggacagctgtgaggaggacctgagtgagaaggagaaggccatcgttcgcgagatgtgcaacgtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgcgttctacgcagcaaggcttcaaagtttcaaactggtttggaactcaaccaggtcctccaaaggaaaccaaggcaggcacaggatgggggcaggctggcttggcaggcagctgtgcggatccacccagagtgccttgggaggcagtggggttggctgtggctgctgtgagctgcagccaggcctctcccgcgtccccagggtctggaaggagggcctctgcacattttataagccacagactgcgaaggcctggagccccaccttccacccataacaaagaaagggatagtttcagaactgcttttatttggataactgactgaaggagtctcatttgtaaccaagatggaattcacagtatgttgttacattcacacttaaaaaatatatctctatgtacaggaatttgcaaagagatgtaaacatacattaatttccaagtacatttctccccttctccctggaggaaaaaaaaaaagccatccaatgaggcaaccccttcaaaataattttaatacaaaggatgcaaacatcta

SEQ ID NO: 353284 - DNA, 3593 bp, Homo sapiens
  misc_feature (896)..(896): n is a, c, g, or t
  misc_feature (1055)..(1055): n is a, c, g, or t
caaagattcagagaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtcnatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacngtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaaggctgctggcgaagtgtctaaacacttgtataaagtgtggaagaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacaggctttttgtttcttttatggactgcaatgtaagcaaacccatccaaccaactccacttctggaactactttatctacggatttagaatgtggtaaattaattcgagaggagagagggattcgaaaacagtcctcagttcatactgtgtaatcagtttaaaaaaaaaaaaaaagatgtgcccagtagaaaatgtttttgctaattggtgttgttgatatttgtatttgctaagcataaatagccacaattctctattcctttaggatagcaaaactcatgtattctagacattgaaatgaatacactggaaagatacttgcactgtatgttgaagcaggggcatattaggggtataaagacttctagaaatgtgtatttacaggaatcttctctgtcccactcatcatcttagttctatcttcatgcattaaaaataagtaactcttccttcat

SEQ ID NO: 353285 - DNA, 3719 bp, Homo sapiens
  misc_feature (896)..(896): n is a, c, g, or t
  misc_feature (1055)..(1055): n is a, c, g, or t
caaagattcagagaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtcnatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacngtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccagaacaagttgagcttggtttgttccccattacttgctcccattggcaaaggtgtgtttgctgtatgtcgtcagttgtgcagtttgctattttgaaaattcttcttattggtttagacaaacatagtcattttgggctgagttttaaaaattacttttagtttataccaagttac

SEQ ID NO: 353286 - DNA, 955 bp, Homo sapiens
tcagaaaggaaagtcatcaagaattagattttattttaggaacaaagtaaggtttcatgggagaaaaaaacaaagccttggtgtagagaaggtttgttcattttctatagcattactgaagtgtccgtatgccttgataatcctatcaatgtttggatcatctcagtgggggaaatgacttaatttaactctattttggtgtctcagcaaaggtaagttatctattttgagagccctgagtttgctttaactgggtagttttatactactgcatttgtgaatgaaatcccaaagtttgcccagctaacttgccatctcagtttccccgattagaaaaggtgggtggccagcgggtggaggaggaggtgatgggaactggccaattgtgacagagctgccttcaagccaatatcttgtgttcataaatacctaggcaagaggcaggtcaacggcacatgcgataggcttaattaagctgatggtctgtatctcatgttccctagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccaga

SEQ ID NO: 353287 - DNA, 3547 bp, Homo sapiens
  misc_feature (896)..(896): n is a, c, g, or t
  misc_feature (1055)..(1055): n is a, c, g, or t
caaagattcagagaagccggaacgtggctccgctcccagttaacctgctggagctcatcaggcttgctcagagcccctgcaccaactcaccctgtaccctctctccttcttcgttagtcttctttcccccttttccctcctctgtctgtgcctatcccccgacttttgcatctgaccaaaggacgaatgagggagacgttcctgcagatcggggcagcaactttcctcagctggtctctgggctccgggagccagagagcgctgatcctccgcggtctgcggcccatggaagaggaggaggaggagccgtgatgggctagcgacagcactgaggagccccgagagagctcagccttgccagccagctccgcggtcccacgcgggttccctcgagctcgctccgtggggagcgcgcagcgtgcttggaaccggagcatccagagaggatgaggcggggacccggcccaagttgggtgcatctctcgggcgtccggcagcggctgtatctcggcatgaattaagaagctaggaagatggagcacggcacactcctcgcccagcccgggctctggaccagggacaccagctgggcactcctctatttcctctgctatatcctccctcagaccgccccgcaagtactcaggatcggagggatttttgaaacagtggaaaatgagcctgttaatgttgaagaattagctttcaagtttgcagtcaccagcattaacagaaaccgaaccctgatgcctaacaccacattaacctatgacatccagagaattaacctttttgatagttttgaagcctcgcggagagcatgtgaccagctggctcttggtgtggctgctctctttggcccttcccatagctcctccgtcagtgctgtgcagtcnatttgcaatgctctcgaagttccacacatacagacccgctggaaacacccctcggtggacaacaaagatttgttttacatcaacctttacccagattatgcagctatcagcagggcgatcctggatctggtcctctattacaactggaaaacagtgacngtggtgtatgaagacagcacaggtctaattcgtctacaagagctcatcaaagctccctccagatataatattaaaatcaaaatccgccagctgccctctgggaataaagatgccaagcctttactcaaggagatgaagaaaggcaaggagttctatgtgatatttgattgttcacatgaaacagccgctgaaatccttaagcagattctgttcatgggcatgatgaccgagtactatcactactttttcacaaccctggacttatttgctttggatctggaactctataggtacagtggcgtaaacatgaccgggtttcggctgcttaacattgacaaccctcacgtgtcatccatcattgagaagtggtccatggagagactgcaggccccacccaggcccgagactggccttttggatggcatgatgacaactgaagcggctctgatgtacgatgctgtgtacatggtggccattgcctcgcaccgggcatcccagctgaccgtcagctccctgcagtgccatagacataagccatggcgcctcggacccagatttatgaacctgatcaaagaggcccggtgggatggcttgactgggcatatcacctttaataaaaccaatggcttgaggaaggattttgatctggacattattagtctcaaagaggaaggaactgaaaagattgggatttggaattccaacagtgggcttaacatgacggacagcaacaaagacaagtccagcaatatcactgattcattggccaacagaacactcattgtcaccaccattctggaagaaccctatgttatgtacaggaaatctgataagcctctatatggaaatgacagatttgaaggatattgcctagacctgttgaaagaattgtcaaacatcctgggtttcatttatgatgttaaactagttcccgatggcaaatatggggcccagaatgacaaaggggagtggaacgggatggttaaagaactcatagatcacagggctgacctggcagtggctcctcttaccatcacctacgtgcgggagaaagtcattgacttctccaaacccttcatgaccctaggcatcagcattctctaccggaagcccaatggtaccaatccaggcgttttctccttcctcaaccccctgtctccagatatttggatgtatgtgctcttagcctgcttgggagtcagctgtgtactctttgtgattgcaaggtttacaccctacgagtggtataacccccacccatgcaaccctgactcagacgtggtggaaaacaattttactttactaaatagtttctggtttggagttggagctctcatgcagcaaggatcagagctgatgcccaaagctctatcgaccagaatagttggagggatatggtggtttttcaccctaatcatcatttcatcctacacggccaatctggctgccttcttgacagtagagagaatggaatcccccatagattcggcagatgatctggcaaagcaaaccaagatagaatatggggcggttagagatggatcaacaatgaccttcttcaagaaatcaaaaatctccacctatgagaagatgtgggctttcatgagcagcaggcagcagaccgccctggtaagaaacagtgatgaggggatccagagagtgctcaccacagactacgcgctgctgatggagtccaccagcattgagtatgtgacgcagagaaactgcaacctcactcagatcgggggcctcattgactccaaaggttacggagtgggaacacctattggttctccttaccgggataaaattactattgctattcttcaactccaagaagaagggaagctgcatatgatgaaagagaagtggtggcgtgggaatggctgccccgaggaagacaacaaagaagccagtgccctgggagtggaaaatattggaggcatcttcattgttctggctgccggactggtcctttctgtatttgtagctattggagaattcatatacaaatcacggaagaataatgatattgaacagtgtctctctttcaacgctatcatggaagaactgggaatctcactgaagaatcagaaaaaaataaagaaaaagtcaagaactaaggggaaatcttccttcacaagtatccttacttgtcatcagagacgaactcagagaaaagagactgtggcgtgatccaaggaaacgcctgtaggaagaaaaaggatgcattccctacagatttttggagaaaggatttctgaggagtgtgtgatgtgtttccatatatctatatccataactctgattatgaatacagatataagaaatacaaaagtttaaaaagctcacatagatatgacttgggaagtgacaccagttcttttaaaataaatttgtatgctcaattattttgcattttttctttttccccaataaattgttgtgtgtgctttctaaataataataaaacaacagggtttttttccaga

SEQ ID NO: 353288 - DNA, 313 bp, Homo sapiens
agctcactgtagcctcaaactcctgggctcaagccatcttcccgccttatcctcgtgagtagctgagactacaggtgtgtgccaccacacccagctaactttttaatttttattttgtagagacagggtttcgctatgttgcccaggctggtcttggactcctggacttaatcctcctgccacagcctcccaaagtgctgggattacagatgtgagccaaagtgtatgacctcacattttaaatttgtagaagaaacaaattgtaaaaatgtgttgtgtttaccaagggtctgcctagtactgtttagtgccc

SEQ ID NO: 353289 - DNA, 327 bp, Homo sapiens
agagcccccaggagccaggacaggttggagtccccactgtcacccagaacaggggcgggcactcaggaaatgcttgacgaatgacagagtgagccccacttgtccacctgttctttccaagccctcagtatgcacaaggcaccaccatctgggacacagatggatcaacctacaacacccctcaacacacacaaacccttaagctgctcacagtctttccaggcagtggagtgtagtagagacaggctgcctggattcgaatcctaactttgccacttagtagctatgtgattttgggttttatttatttatttatttatgaaacag

SEQ ID NO: 353290 - DNA, 219 bp, Homo sapiens
gaagaaggcaagagtaacctcttgaaacatgtttgaggaggacaaatatatcaggcagtgattagtaacatctgagtaataatgaatttatcagattttttttttttctcctgagatggagtctcactctgtttcccaggctggagtgcggtggagcaatctctgctcactgcaccctctacctcccgggttcaaacgattctcctgcttcagcctgct

SEQ ID NO: 353291 - DNA, 456 bp, Homo sapiens
cgtggctttgagcctcagaaacggtgcaaaatgcagtccacgcgtggctttcggccccggtctggtgctcggaagacatgtgcctccctctacctgccccccgtcctcccgccactgtgaggccctgagaggccctgagattcttgcgatgtgtgaataagggtgccgcattttcatgttgcactgggcactgaatggtggagctgagtgatgcggtttggttctgtgtccccacccaaatctcatctcagattataatccccacctgtcaagggagagacccgctggaggtgagtgcatcgtggggccattcaccccatgttctcgtggtagcgagaaagttctcacaagatctgtttgttgttgtttttgttggtggtggtggtttttaagacggagtttcactcttgttgcccactgcactccagcctgagtgacagagcgagactccgtatc

SEQ ID NO: 353292 - DNA, 518 bp, Homo sapiens
tttgagacagagtcttgctctatcacccaggctggagtgcagtggcgcgatctcggctcactgcaagctccgcctcccgggttcacgtcattctcctgcctcagcctcccgagtagctgggactacaggcgcctgccaccttttttttttgtatttttagtagagatggggtttcacggcgttagccagaaaggtctcgatctcctgacctcgtgatccacccgccctggcctcccaaagcgctgggattataggcgtgagcctctgcacccggtcacctcattttttaaaatgtacaaatgaaaaagggtccatttccacgatggcgccttgtgcatatgcgagccacgagtctccaagaagcgggtgggagaggaactgtatgggccttagtgggggacgaaaggaaggctctgcagctcctcttctcaccgcgacatcccctccacggcctgaacacaggttgggcgatccctgcccagatacaggactgcagcccagtgctccctggactccag

SEQ ID NO: 353293 - DNA, 469 bp, Homo sapiens
ctttttgtttgtttgtttgagacagagtctcactctgtcactcaggctggagtgcagttgcacaatgtcggctcactgcagtctacacctttcaggttcaagcaattctcctggctcagcctcctgagtagctgggattacaggtgtccaccaccacacctggctgatttcttttatttttagtagagatagggtttcaccatgttggccaggctggtcttgaactcctggcctcagatgaagtgcctccttggcctcctaaagtgcagggattacagatgtgagccaccacgaccagccttctcagaacgtattcttgtctttaagtgataagtgactgtatgtgtctgcattgtccaattaagggtagccactagctgcatgtggcttttgagcacttgaaatatgcctagtctgaatagaggcatgctgtgttacacatacgtactattttcaaagatttagtatg

SEQ ID NO: 353294 - DNA, 3680 bp, Homo sapiens
gcagccttgtaagtaacgccgcggaccgggaaagtgggaggggccgctcccggaacgcagccttcttgtaagaacctccaaggaagcaagaagaaaaaagaggcgctaccctgcgctcccgggaggcctctgaaagcttccactagagaaaaactccccactcttacaatttctttaaccgcaagaagcggaggacctggacaaggactcgaggagcaaggtggcgaaccaagggtagggcgcaccgggcccgagaggtcccccgcaggttgcagatacggtggactctctgcggcttctgagcacggagggagctgtcgcggggtcgggaggtcgtctctcatccctgcctcatcttccgacggccggcggggccatgtccagaggcccgagctccgcggtcctgcctagcgccctgggatcccggaagctcggcccccggagcctcagctgcctgtcggacctggacggcggcgtggccctggagccgcgggcctgtaggccccctgggagcccgggccgcgcgccgccgccaacgccagcgccgtcgggctgcgacccccgcctgcggcccatcatcctgcggcgggcgcgctcactgcccagctcccccgaacgccgccagaaggccgcgggcgccccgggcgctgcgtgtcggccgggctgcagccagaagctccgcgtgcgcttcgccgacgccctgggcttggagctggcacaggtcaaggtgttcaacgcgggagacgacccgtccgtgccgctgcacgtgctgtcgcggctcgcaatcaactcggacctgtgctgcagcagccaggacctggagttcaccctgcattgcctggtgcccgatttcccgccgcccgtcgaggccgccgactttggcgagcgcctgcagcggcagctcgtgtgcctggagcgtgtcacttgctcggaccttggcatcagcggtacggtgcgcgtgtgcaacgtggccttcgagaagcaggtggctgtgcgctacactttctcgggctggcgcagtacccacgaggcggtggcgcggtggcgcgggcccgcaggccccgagggcacggaggacgttttcaccttcggctttccagtaccgcccttcctgctggagctcggctcccgcgtgcacttcgcggtgcgctaccaagtggcgggtgccgagtactgggacaacaacgaccaccgagactacagcctcacatgtcgcaaccacgcgctgcacatgcctcgcggggagtgcgaagagagctggatccacttcatctgagccgcgcggggaccggccacctggagcctccacacctaagctgcgcctcctgtcatttccctgctgggctctcacatctatctggttgttcttcaccaccctccaagtcctctgacctaattttctgctgcaaggtcccctggcagtggcccatcctgtcttctacttgaaacgtctgagtcacttggtctaaaaagtagcctcaggtggccagaaggccgagttgtgtaatgagttggggcagggtggtggggtaggtgcatgggagggtgggccctctggggaggcccaagcagcttgttttgcaaaggcccaagtcctcctgctaggaaaagcttttgcatgtgtcctgaatgtgtctctgtaaacatagctgttatttattattgtgatgttgggacctttagcccatagcggatgcctcctcaggaatattctcgatttaataagctaaaaaaaaaaagttctgtgtttgtgcccacagtaaacagaatgtacagtgtgacccacatcgtggtccctccaggcattcctgccccaggataaggaaaacctgagcccacatctgattgccaacggctgtagccttctaacagtgggaaactattaataggcaagaaatttctgctttatcagtcatcacacaaccattcctgggcattgagactgtcctggttaggctgtgtgtctcctacattaacagctggggaggagggaaaagcttcagacttttaaactagcaaaacagttatttctctgcattcacaattctgatttcatgtatttctctgtacatgtttgatcattatcaggccattctgtttaagtttgaaactaagcattttaagaagtcttgcctcagttatttcagttttcaggtgactagagaatttcaggcaacagtgccctttgcaattacctttttgatgattaaggtgactatttttatttcttgttaagcatcagaagatgtcagcattcatcttttgggagtccagttacaaggtggaactagaaggtgttttcagcaatagccagagcactggaggaaaaataattgacaaatatttatacttttaaattgttttgaactgtatttacatacatcatgttttatcaggtacccaccaactttatactttctgccttcagatagagtttctaacattttctagtttgtcagttttaaaatataaaattcttttatgtttttaaaccgtcaaccaagaagtcaagaccactgtcccctgctgagttaggcaatcacttaaaactccaaagaactccaggctgaggagttcttttggtgctgaacagtggtctgacaacaggtgctagaattaaggtgtgggaaaaaaaaaaaaacagccaggaaggacaagatctccaattttgtgaagcttatgatacagctgaaaccagtctgatcaattttatgctacctgtcaccaagaaattaactctaaatttttgaatgcttgttggcatctgtcaaatcaatactgaaaggatgcatttcggcttttaaccagtttggttctgatcattgcaacctctgtgcttttataattcaaagaacaaggatagctttcttcggtatcttttaatataagaacactgaattttggcttgaaatattgtgactaaattgcacaatctctggctattagcactgttcactacattaacatgcaagagagagagaagccttgttacatttcctgctatttaacaaactgtccaattaggtcagcaagcctgttagggccttcactgctacgcccctggccccaaaacagagagcaagacagttgtccagagaatttagatatgagttaagagctgccagatttattttaaggcatgtagagaatctcataatctatgtgaaagtcacttgccaaaaaggttttggttatgaaagtgaatgttatatatttaatattaagtgaacctcccgtgccttttaaaaaataccaacattatgaaatttaaaagcttaaatatatttgcctagttgataaagaggctgtggaacaactgaaggagaactttcagaccctaaaacagttatattacttagatgttaaaattttctagtgggctgtgcaattgctgggttgtccccccaaacatattttaatatgttatttaaaatgattttacccaagcctaagtattaaagtatatgtgcaaaaaacaaaaaaaagacacaacaaaaaaactgttgggggcggccacgccccagaaaaagttcaacccatatcgggggggcggggccccggagtaagttaccatgggcacaacctgtccccaagaaaccgggcacgccaggcgggggttctccaaaaaaacccccgggcacggggtctgacaacccaggggcgggccacgggcacacggc

SEQ ID NO: 353295 - DNA, 3475 bp, Homo sapiens
gcagccttgtaagtaacgccgcggaccgggaaagtgggaggggccgctcccggaacgcagccttcttgtaagaacctccaaggaagcaagaagaaaaaagaggcgctaccctgcgctcccgggaggcctctgaaagcttccactagagaaaaactccccactcttacaatttctttaaccgcaagaagcggaggacctggacaaggactcgaggagcaaggtggcgaaccaagggtagggcgcaccgggcccgagaggtcccccgcaggttgcagatacggtggactctctgcggcttctgagcacggagggagctgtcgcggggtcgggaggtcgtctctcatccctgcctcatcttccgacggccggcggggccatgtccagaggcccgagctccgcggtcctgcctagcgccctgggatcccggaagctcggcccccggagcctcagctgcctgtcggacctggacggcggcgtggccctggagccgcgggcctgtaggccccctgggagcccgggccgcgcgccgccgccaacgccagcgccgtcgggctgcgacccccgcctgcggcccatcatcctgcggcgggcgcgctcactgcccagctcccccgaacgccgccagaaggccgcgggcgccccgggcgctgcgtgtcggccgggctgcagccagaagctccgcgtgcgcttcgccgacgccctgggcttggagctggcacaggtcaaggtgttcaacgcgggagacgacccgtccgtgccgctgcacgtgctgtcgcggctcgcaatcaactcggacctgtgctgcagcagccaggacctggagttcaccctgcattgcctggtgcccgatttcccgccgcccgtcgaggccgccgactttggcgagcgcctgcagcggcagctcgtgtgcctggagcgtgtcacttgctcggaccttggcatcagcggtacggtgcgcgtgtgcaacgtggccttcgagaagcaggtggctgtgcgctacactttctcgggctggcgcagtacccacgaggcggtggcgcggtggcgcgggcccgcaggccccgagggcacggaggacgttttcaccttcggctttccagtaccgcccttcctgctggagctcggctcccgcgtgcacttcgcggtgcgctaccaagtggcgggtgccgagtactgggacaacaacgaccaccgagactacagcctcacatgtcgcaaccacgcgctgcacatgcctcgcggggagtgcgaagagagctggatccacttcatctgagccgcgcggggaccggccacctggagcctccacacctaagctgcgcctcctgtcatttccctgctgggctctcacatctatctggttgttcttcaccaccctccaagtcctctgacctaattttctgctgcaaggtcccctggcagtggcccatcctgtcttctacttgaaacgtctgagtcacttggtctaaaaagtagcctcaggtggccagaaggccgagttgtgtaatgagttggggcagggtggtggggtaggtgcatgggagggtgggccctctggggaggcccaagcagcttgttttgcaaaggcccaagtcctcctgctaggaaaagcttttgcatgtgtcctgaatgtgtctctgtaaacatagctgttatttattattgtgatgttgggacctttagcccatagcggatgcctcctcaggaatattctcgatttaataagctaaaaaaaaaaagttctgtgtttgtgcccacagtaaacagaatgtacagtgtgacccacatcgtggtccctccaggcattcctgccccaggataaggaaaacctgagcccacatctgattgccaacggctgtagccttctaacagtgggaaactattaataggcaagaaatttctgctttatcagtcatcacacaaccattcctgggcattgagactgtcctggttaggctgtgtgtctcctacattaacagctggggaggagggaaaagcttcagacttttaaactagcaaaacagttatttctctgcattcacaattctgatttcatgtatttctctgtacatgtttgatcattatcaggccattctgtttaagtttgaaactaagcattttaagaagtcttgcctcagttatttcagttttcaggtgactagagaatttcaggcaacagtgccctttgcaattacctttttgatgattaaggtgactatttttatttcttgttaagcatcagaagatgtcagcattcatcttttgggagtccagttacaaggtggaactagaaggtgttttcagcaatagccagagcactggaggaaaaataattgacaaatatttatacttttaaattgttttgaactgtatttacatacatcatgttttatcaggtacccaccaactttatactttctgccttcagatagagtttctaacattttctagtttgtcagttttaaaatataaaattcttttatgtttttaaaccgtcaaccaagaagtcaagaccactgtcccctgctgagttaggcaatcacttaaaactccaaagaactccaggctgaggagttcttttggtgctgaacagtggtctgacaacaggtgctagaattaaggtgtgggaaaaaaaaaaaaacagccaggaaggacaagatctccaattttgtgaagcttatgatacagctgaaaccagtctgatcaattttatgctacctgtcaccaagaaattaactctaaatttttgaatgcttgttggcatctgtcaaatcaatactgaaaggatgcatttcggcttttaaccagtttggttctgatcattgcaacctctgtgcttttataattcaaagaacaaggatagctttcttcggtatcttttaatataagaacactgaattttggcttgaaatattgtgactaaattgcacaatctctggctattagcactgttcactacattaacatgcaagagagagagaagccttgttacatttcctgctatttaacaaactgtccaattaggtcagcaagcctgttagggccttcactgctacgcccctggccccaaaacagagagcaagacagttgtccagagaatttagatatgagttaagagctgccagatttattttaaggcatgtagagaatctcataatctatgtgaaagtcacttgccaaaaaggttttggttatgaaagtgaatgttatatatttaatattaagtgaacctcccgtgccttttaaaaaataccaacattatgaaatttaaaagcttaaatatatttgcctagttgataaagaggctgtggaacaactgaaggagaactttcagaccctaaaacagttatattacttagatgttaaaattttctagtgggctgtgcaattgctgggttgtccccccaaacatattttaatatgttatttaaaatgattttacccaagcctaagtattaaagtatatgtgcaaaaa

SEQ ID NO: 353296 - DNA, 842 bp, Homo sapiens
attcaattaatttatggttgaaaattttttaatatttttttaaaatcaggatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttgattttgtagctctagtcatgaattaattattgtgtgtatgtatttgaaatctcttagacatatcttttcaaacaaatacttaaacttgagtctgttacctctgagaatgtctgtcacaatcacagcccctggtgaccaacagtgccataaatggttcccctgaaatacccatattctgaccccatcacccgggtcacaaatgatgacaccagtgctgggtacccaaattaagggcgactaacatgtaagtaggatgatgaatggtttgaagtgtaaattgtgtgaaatagttcagcatgaaagctctgccctgagaaataatgactgattatacccgttagaaacccttcagactgttgaacttgagacacacagacacaacagacacagactagtgggtgtgggagcagaagcataggcactctcaaatagagaagacatttgc

SEQ ID NO: 353297 - DNA, 410 bp, Homo sapiens
aatattttcgcattttctgttgaatataagagccggccatgtaggcctcgagggttacaggagatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353298 - DNA, 386 bp, Homo sapiens
cgcctcaccacggatcatggggaggctggcggtttcgggatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353299 - DNA, 832 bp, Homo sapiens
gcatagctgcaacgactctcttaacctccaccgctacacgatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttgattttgtagctctagtcatgaattaattattgtgtgtatgtatttgaaatctcttagacatatcttttcaaacaaatacttaaacttgagtctgttacctctgagaatgtctgtcacaatcacagcccctggtgaccaacagtgccataaatggttcccctgaaatacccatattctgaccccatcacccgggtcacaaatgatgacaccagtgctgggtacccaaattaagggcgactaacatgtaagtaggatgatgaatggtttgaagtgtaaattgtgtgaaatagttcagcatgaaagctctgccctgagaaataatgactgattatacccgttagaaacccttcagactgttgaacttgagacacacagacacaacagacacagactagtgggtgtgggagcagaagcataggcactctcaaatagagaagacatttgc

SEQ ID NO: 353300 - DNA, 264 bp, Homo sapiens
  misc_feature (56)..(56): n is a, c, g, or t
gagcgcgttcgcgccgaataccctctttatatttgagaaagcgcgctttcggtatncacagatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353301 - DNA, 254 bp, Homo sapiens
agacttaaattagaggtttgcgctcgcaaccagaccacaggcagcttgaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353302 - DNA, 251 bp, Homo sapiens
ttttatttttttatatataatataccgaaccccccaagccacaccgggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353303 - DNA, 220 bp, Homo sapiens
actttttcctcctagggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353304 - DNA, 266 bp, Homo sapiens
gctgctgggaacctctcttattctcaccgctacaagatttccagactgtattaccatcatttgagctcttctcaaagtatggaaaattatattcaaaagctggacagattgtataaaggaaatgaatgtctagtgtttaattttggcgtcagaagaagaaactgaagccatctgcattttaaaacttaacagttctgaaaggaaaacacagatgaagatcctgtaggaaatatacttgctatgattcaataaactataaaattttg

SEQ ID NO: 353305 - DNA, 1412 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353306 - DNA, 1857 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttgattttgtagctctagtcatgaattaattattgtgtgtatgtatttgaaatctcttagacatatcttttcaaacaaatacttaaacttgagtctgttacctctgagaatgtctgtcacaatcacagcccctggtgaccaacagtgccataaatggttcccctgaaatacccatattctgaccccatcacccgggtcacaaatgatgacaccagtgctgggtacccaaattaagggcgactaacatgtaagtaggatgatgaatggtttgaagtgtaaattgtgtgaaatagttcagcatgaaagctctgccctgagaaataatgactgattatacccgttagaaacccttcagactgttgaacttgagacacacagacacaacagacacagactagtgggtgtgggagcagaagcataggcactctcaaatagagaagacatttgc

SEQ ID NO: 353307 - DNA, 1473 bp, Homo sapiens
  misc_feature (1414)..(1414): n is a, c, g, or t
  misc_feature (1439)..(1439): n is a, c, g, or t
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttgcngtatgcggccagattctgctttatntgggcgccatacactcgacagccactactccccc

SEQ ID NO: 353308 - DNA, 1474 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttgcccaccacaacaaatgatgccccaacccaaacaaaacactaaaatgggctccttggcctcta

SEQ ID NO: 353309 - DNA, 1302 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaagaaaacagaagatgaaatgtaaaactgagattaaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353310 - DNA, 1325 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttgcaacacggatgcggccgtagtcaaataaaggttgcaaatgaaaaaggataaaacaaa

SEQ ID NO: 353311 - DNA, 1393 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaagagagacagggtctcactctgttgcccagggtggaatgcagtggcgtgatcatagctcactgcaacctcgaactcctgggtcaagtgatcctcatgcctcagcctcttgagtagctgggattacaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353312 - DNA, 450 bp, Homo sapiens
atggagtctcgctgtgtcgccaggctggagtgcactggcatgatctcagctcactgcaacctccgtctcctgggttcaagctattctcctgccttagcctcccaagtaactgagactacaggatttccagactgtattaccatcatttgagctcttctcaaagtatggaaaattatattcaaaagctggacagattgtataaagagagacagggtctcactctgttgcccagggtggaatgcagtggcgtgatcatagctcactgcaacctcgaactcctgggtcaagtgatcctcatgcctcagcctcttgagtagctgggattacaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353313 - DNA, 1268 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353314 - DNA, 1598 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcagtgatctgaaatactcaagtgtgttagttacatcaatcagcccaattaggatgccttgctttaagcaattggaaactattgaaagtctatgatcttaaaaattcaaaaaaggagttgataaaagcaatactttacaaaattaatctagaagaactgttccaaatggattaaacagaagattaagcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttg

SEQ ID NO: 353315 - DNA, 1450 bp, Homo sapiens
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaagaaaacagaagatgaaatgtaaaactgagattaaggtgtgaagtgagtgtgaatagaagaccccacactgcctggagtcctggattcttccacgtctgatgagtgaccttggatctcttaatctctctagttttctctctcttaggcgtcagaagaagaaactgaagccatctgcattttaaaacttaacagttctgaaaggaaaacacagatgaagatcctgtaggaaatatacttgctatgattcaataaactataaaattttgaaaaaaaaaacaaatggacctaactggaactcactgga

SEQ ID NO: 353316 - DNA, 1322 bp, Homo sapiens
  misc_feature (1269)..(1269): n is a, c, g, or t
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttgnagatcggccgacgactaaacattaaatacataaaaaacaaaagcgggggggag

SEQ ID NO: 353317 - DNA, 1323 bp, Homo sapiens
  misc_feature (1269)..(1269): n is a, c, g, or t
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttgngatgcggccagtcgtttcccccgtctacgtgcacagaggggacaaatgaataaa

SEQ ID NO: 353318 - DNA, 1324 bp, Homo sapiens
  misc_feature (1279)..(1279): n is a, c, g, or t
agcccagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacaaaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttgcaggatgcgancaggcaccgtccccgttctcacgcgggaaatctatattaacatgt

SEQ ID NO: 353319 - DNA, 2239 bp, Homo sapiens
ctatgattctcgaatcgttatgaatatcaaatgtccatttctattgtaatgaattcagtggaaccatcacacaaaagcacacaaagacctcctcctccacaggggagacagagaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353320 - DNA, 798 bp, Homo sapiens
ggccaggctggtctcgaactcctgagctcagcccatctgccgtgctcagcctcccaaagtgctgggattacaggcatgagccaccacgcccagcctcatattgttttgactttccttaaggatagtaatcttaaggaattactattccttgagaatagtaatcaaaatttatccggttaaatagtcttaactgttataaaccatattattttataaagcgtcatttttcttggtcgagcaagtgtatagtattgtcgaaatgaaatttaactgtctgccttctttttactttaagaagtacttctctgggtttttgttttcttcctttcctttgtgtaggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgt

SEQ ID NO: 353321 - DNA, 1454 bp, Homo sapiens
tttatccaggccattgcggaaaacagggccgatgctgtgcacccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaaccctcataccattaacttgttgcagaaactatgttgtttgtcctgtagaaagttccacatgctgtagttgtctatttgcttcttggtgttaaccatttaacttgctcctcttctttgttttctgtgaatggaaattagctctagattagaggcttgattaggttcaacatttttttttttttttttttggcaagcagatatttggttgtcctgttcttagtaatggtgagcttaatcagtagctgcacagggacaacctcttccctctgtctgctgtcaagttccctattaaccttatatctgatggttttatccaataataaattgtttcctgagtcagttatttcattcagaattgcaaagtgatgatttttagtttagttattccttccatgtttaatggaattcttctgtaatgaagaacttctctcaaagctgccaactagggttgccctaaagtataatatatacaagaaaaatagtaatgcttttctttttaattgtcaaatacagtaaggaatttcagtgaggatgtttgtgtgtgttttggagatggggtcttgctttgttgcccaggctggagcgtagtgacacagtcatagctcagtgcagcctcgaattcctggactcaagggatcctcctgcctcggcctcctgagtaactaggactacaggcaggtagctgggactacatacgtgtaccagcacacccagctattttttaaaaaaactttgtagaattttgaatgagccacagtgcctggctgaggatggtttcgagttaaaagttttcacgctgttacaatttatagtttcacaagaatgtttaaacatcag

SEQ ID NO: 353322 - DNA, 653 bp, Homo sapiens
ctatgattctcgaatcgttatgaatatcaaatgtccatttctattgtaatgaattcagtggaaccatcacacaaaagcacacaaagacctcctcctccacaggggagacagagaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagaattctgcttggtcagaatcgtgatggcattgtgttcagcactgatgactattttcaccatcaagatgggtacagcaaaacagtaaccggatcgagaacata

SEQ ID NO: 353323 - DNA, 980 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaaggtgagtagacaccccgttttaggtgagggtggggcggtggtggtgtttttcgctttcacttcttgactggactgtttagattagctgtaaacgtagacgtaagctctgtgtgaacttttgcgcctcagag

SEQ ID NO: 353324 - DNA, 603 bp, Homo sapiens
ctatgattctcgaatcgttatgaatatcaaatgtccatttctattgtaatgaattcagtggaaccatcacacaaaagcacacaaagacctcctcctccacaggggagacagagaattctgcttggtcagaatcgtgatggcattgtgttcagcactgatgactattttcaccatcaagatgggtacagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagaattctgcttggtcagaatcgtgatggcattgtgttcagcactgatgactattttcaccatcaagatgggtacagcaaaacagtaaccggatcgagaacata

SEQ ID NO: 353325 - DNA, 678 bp, Homo sapiens
gttagcatctgtaattgtgtagatttaagtgtaaagtgatttgaaatctgaaatctttgtaagattattcagctcttgtgctggtctgttcgtgatatactttcaggtaagtatcagaaatccatttaataacctttcctgtgtgatttatttcacttggttatatttatttctgatagtttatttctgatggttatagattttgtaaatggcacctttatgatttcttttattaacagaattctgcttggtcagaatcgtgatggcattgtgttcagcactgatgactattttcaccatcaagatgggtacaggtataatgttaatcaacttggtgatgcccatgactggaaccagaacagagaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggttattcccccttggaattttgagtcttatttatcactgagagttccaggactttgtt

SEQ ID NO: 353326 - DNA, 282 bp, Homo sapiens
  misc_feature (240)..(240): n is a, c, g, or t
  misc_feature (249)..(250): n is a, c, g, or t
  misc_feature (257)..(257): n is a, c, g, or t
ctatgattctcgaatcgttatgaatatcaaatgtccatttctattgtaatgaattcagtggaaccatcacacaaaagcacacaaagacctcctcctccacaggggagacagagaattctgcttggtcagaatcgtgatggcattgtgttcagcactgatgactattttcaccatcaagatgggtacaggtataatgttaatcaacttggtgatgcccatgactggaaccagaacagagcnaaacagctnncgatcgngacatagggtaccgctcgattcgta

SEQ ID NO: 353327 - DNA, 4235 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353328 - DNA, 4168 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353329 - DNA, 4142 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353330 - DNA, 3991 bp, Homo sapiens
  misc_feature (6)..(6): n is a, c, g, or t
  misc_feature (18)..(18): n is a, c, g, or t
  misc_feature (53)..(53): n is a, c, g, or t
  misc_feature (126)..(126): n is a, c, g, or t
ccgagnaacccgggaccnacggccgggtagcccggggacccaccaaaccgggnacccccaccacacccccgacccaattttttaaaaaaaaaaccttgtaagaaattttggaatggaggcccacantcccccggccgaggatggtttccgagttaaaaagttttccacgctgttaacaatttaatagtttccacaagaatgtttaaacatcagataagtttgatcataagactgtttcctagtatttattttataacgctctagaatttctccaaatatattagagggtggcatagcagtctaaaaaaatattaatttttttatttttttaatgccatagaacatttttgctcaaatcaaataatgatggtattgcaattctgaaaatgtttggagttactggcctaaaggtaaggggagcaagattagttgataagttgaatgaatagacagggcagagccagtatacctttggtgaactagtaagtttatttgcgtgggacattttttttctctttgcagtactatcttgcgtacggaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353331 - DNA, 4178 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaacacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353332 - DNA, 4242 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggtaaaataatagcagcatgggatattttaagaggctttattttatacttgatgagtaaattcagagaactttgaatctgtaccattgttatgtagtcccaaagttatttccccgagaataatgctaatgttttccaaggcttaatatactggttgtgaatattaaaagtttttctcattgatattgctctacaagaaacctacttaatacattttttagcggacatgggtcaatttctgtttatcattaataggggttcttaacctgggctacacttttgaatttcttggggactttaaaaaaagcaaaaaaaaaagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaaccctcataccattaacttgttgcagaaactatgttgtttgtcctgtagaaagttccacatgctgtagttgtctatttgcttcttggtgttaaccatttaacttgctcctcttctttgttttctgtgaatggaaattagctctagattagaggcttgattaggttcaacatttttttttttttttttttggcaagcagatatttggttgtcctgttcttagtaatggtgagcttaatcagtagctgcacagggacaacctcttccctctgtctgctgtcaagttccctattaaccttatatctgatggttttatccaataataaattgtttcctgagtcagttatttcattcagaattgcaaagtgatgatttttagtttagttattccttccatgtttaatggaattcttctgtaatgaagaacttctctcaaagctgccaactagggttgccctaaagtataatatatacaagaaaaatagtaatgcttttctttttaattgtcaaatacagtaaggaatttcagtgaggatgtttgtgtgtgttttggagatggggtcttgctttgttgcccaggctggagcgtagtgacacagtcatagctcagtgcagcctcgaattcctggactcaagggatcctcctgcctcggcctcctgagtaactaggactacaggcaggtagctgggactacatacgtgtaccagcacacccagctattttttaaaaaaactttgtagaattttgaatgagccacagtgcctggctgaggatggtttcgagttaaaagttttcacgctgttacaatttatagtttcacaagaatgtttaaacatcag

SEQ ID NO: 353333 - DNA, 4350 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcggtaagtaaaggataccaactgaatacttggtaattcattatttaaaaattataaatgatatttgtcgccggctgcagtgactcatgcatgtaatcccaacactttgggaggccagggtggaccagtcacttgagctcaggagtttgagaccagcctgggcaacatagtgagaccctgtctctaaaaaatgaaataaaaatgttagaactataatgatacttgtaatcactgacaagtgcttttatgtttctagtagaagaaaatctttaatttgctacacttgagaatagcatctgacagtgtaactatttaaaaatcttttctgatagaagaaaggagaattggcatatgtttatatttagattctgctaagggctttaaaaatagataacactacgtataattatggcagtgatgaaagcaaatgctacttgagaactgtcctggcctacccttttgagtcagctgttcaaggaaagttggactcagtgttagaaaatttgagtttttcaagttcagttggaggtgagaaaaagagaaaatttgggtattgactcagttatttccctttttcaccttgggcaagttttgctctctgttaatggaataaatgatacttactttttctggaattgggaatcaaatgagatgacccaaggaaaggaattttgaatgtgttgagcactgtgccatgttcataccattgattggcagaaggaacccttttttgatttcttaaaattcaggagtttgaagtgagtaatatctgaattggtgttagaactgttggtggtttattgtattacaagatatttcaaattcctttttttgtttacatttttaaactattgatgcacttgaatatgtttatgcagttgtgaaaaaatagtgtaaagaaagcagtacaaattatcttgagtttatataagatgattcaagatttgtgccggacaaggagaaaaagaaaatttgttgatatctttgggtgaggatggagaggtccaagaaaccattttgcaaatgttttatattactaacaagacaatctaaacctaaataaacatctttttcagagaaaagacactagagaaagatttaatttgtgatatttcaagctagattataaactgtgatctttgtgaatgaattaattcattccagaattaaattttggtctttgtattttgattccttttactttagtgaggattttgtagagaagatgaaatttcacctctataataatagaagttaggagtgaggtctcacaaacatgggctgtcttctagatttgggatataccatcagagacaataaataactgaaatttggaaactggataaaagagtctgctagttaggaccacttgactaagagtgggtatagaagaaacctaaggaagaaaagttagatttgagacaacatattggagtatgttgaaattaaaggtgaataaagtagtggaaattcgatagaatttaaaggagacattgtagtgggagatggtagaggtgattagatataatatgtatatttatttgaaaaatagatatataagaatgaaagttgtatgtagtaccaacaagtaccattcgtattatgattcacaatttacagagtattttcatatataaaaatcttgtgcaatgggttgttttttcattttatagaaggagcagaggctaaaggaagttgaggttaagtgatttggaagttacaaaaactagtaagagctcaaactagcaataaaattatagtatgtttttcccttgccttcactgtaatgcttaatggttgtgtagtcttatacgtgactcctgacttcaaggatcctggtctgtacctctttaggtcaacacgttttgagtgaactggtgttggttatttggaattagatataaagtcatatattctttggtgaggaatggcttcatataggagttcacattcaaaacaagctttgacaaaataatagagtgaaaattggtagatcagagttgagctgattggaggaccaaattaaaagactggctgggcatgatggctcacacctgaaaacccagcactttgggaggccaaggcaggcagattgtttgagcccaggaattcaagaccagcctagataacctgggtatcccagctacttgggaggctgagctgccgaggctacagtgagccatgatcgtgccattgctttctagcctgggtgacagattgagaccctgtctcaaaaaaaaaaaa

SEQ ID NO: 353334 - DNA, 5353 bp, Homo sapiens
  misc_feature (5351)..(5352): n is a, c, g, or t
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagtgactgaagaaatatcaaatgtttcctagtaagacagcaactcaggactctaggatggaagaaggtgtctgaccgtaaattacacctgcagtgcaaccagcagactaatggggatgaggttctggtacaagatgatgaacaccagtatgtcagacaatgacttgggagctggaatcaaggacatgaccaagagcagcaagaacaaaagggagactgacacattgatcactttctcaacctttgatctcttgagaggatggttcacatttgagtaaagacaggggagtttgttttcagaatgacatactagtctgcaggatgaatttcataactgacattgcaccttggactgcaactaggactttcactggaatcagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatcactagcatccatctctggaactcttttcatcttgcaaaactgcaattctatacccattaaacaatgacccatnnc

SEQ ID NO: 353335 - DNA, 3579 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggtaaaataatagcagcatgggatattttaagaggctttattttatacttgatgagtaaattcagagaactttgaatctgtaccattgttatgtagtcccaaagttatttccccgagaataatgctaatgttttccaaggcttaatatactggttgtgaatattaaaagtttttctcattgatattgctctacaagaaacctacttaatacattttttagcggacatgggtcaatttctgtttatcattaataggggttcttaacctgggctacacttttgaatttcttggggactttaaaaaaagcaaaaaaaaaagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaaccctcataccattaacttgttgcagaaactatgttgtttgtcctgtagaaagttccacatgctgtagttgtctatttgcttcttggtgttaaccatttaacttgctcctcttctttgtttataaaggcagcgattacatacccacccacctctccagagttagggcatggggcc

SEQ ID NO: 353336 - DNA, 4058 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaatcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggtaaaataatagcagcatgggatattttaagaggctttattttatacttgatgagtaaattcagagaactttgaatctgtaccattgttatgtagtcccaaagttatttccccgagaataatgctaatgttttccaaggcttaatatactggttgtgaatattaaaagtttttctcattgatattgctctacaagaaacctacttaatacattttttagcggacatgggtcaatttctgtttatcattaataggggttcttaacctgggctacacttttgaatttcttggggactttaaaaaaagcaaaaaaaaaagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaaccctcataccattaacttgttgcagaaactatgttgtttgtcctgtagaaagttccacatgctgtagttgtctatttgcttcttggtgttaaccatttaacttgctcctcttctttgttttctgtgaatggaaattagctctagattagaggcttgattaggttcaacatttttttttttttttttttggcaagcagatatttggttgtcctgttcttagtaatggtgagcttaatcagtagctgcacagggacaacctcttccctctgtctgctgtcaagttccctattaaccttatatctgatggttttatccaataataaattgtttcctgagtcagttatttcattcagaattgcaaagtgatgatttttagtttagttattccttccatgtttaatggaattcttctgtaatgaagaacttctctcaaagctgccaactagggttgccctaaagtataatatatacaagaaaaatagtaatgcttttctttttaattgtcaaatacagtaaggaatttcagtgaggatgtttgtgtgtgttttggagatggggtcttgctttgttgcccaggctggagcgtagtgacacagtcatagctcagtgcagcctcgaattcctggactcaagggatcctcctgcctcggcctcctgagtaactaggactacaggcaggtagctgggactacatacgtgtaccagcacacccagctattttttaaaaaaactttgtagaattttgaatgagccacagtgcctggctgaggatggtttcgagttaaaagttttcacgctgttacaatttatagtttcacaagaatgtttaaacatcag

SEQ ID NO: 353337 - DNA, 3125 bp, Homo sapiens
ttttgagacagagtctcactctttgctcaggctgtagtgctgcggcgtgatcttggctcacagcaacctccacttcataaggttcaagtgattctcgtgcctcagcctcccaagtagctgggactacaggcgcataccaccacacctggctaatttttttatttttaatagagatgaggttttgccattttggccagggtggtcttgaattcctgacctctggtgatccacctgctttggcctcccaaagtgctgggattataggtgtgagctaccacacccagccttgtgacagtgattcttatctcatagtgcaaaagatggcatttggatgggagataatagttcagaaaagttccattctacagcaactcacaatttgaggaccatagttctaagaaatatccacaaagtcagttgaactatgatttttagctacttggcatataaagttttgctggtaagtaatgacttaaatccataacttttcaaaaacataagccttacttcaaaagcattatttgtacattgtagaaaattagaaaatacagataatcatctgcggtaactttcccaaaaaagagaaaatacagataaaatattaaatgaaaatattcttaccacctacaggcgaccaattttaatatctccataagtcttccccagctctatcttttgacttaaataggatcatatttaactattgtcttgtaacttgccattttcatttaataacctccatccttccgtgtcaaaataatttttcacctcttctcttacttagtctatattcagatgtaaattgttcatctcttatatttcccataagtgaaagttagtcctagacttgaagcctttattagctgtaagttcagcaaaatgcctttcagagccagtttgtcaaagccagcatccagtctggagaatgcacctggcatatggttgtgtcctttaattccctttcaatctagtggagttctttttttcatgatactgactgaagagattgcacagttttggttttaagtacagagacgtagtacatttcttaataataaatgtttaacttttgtgtgttttaacctaatttgtttttttatttttaaatttatattttatttcagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353338 - DNA, 4283 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaaccctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaaaaaaaaaaaaaaaaaaagaaaaaaaaaaaaaaaaaaaaaaaaaaaagaaaaaaacagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaaccctcataccattaacttgttgcagaaactatgttgtttgtcctgtagaaagttccacatgctgtagttgtctatttgcttcttggtgttaaccatttaacttgctcctcttctttgttttctgtgaatggaaattagctctagattagaggcttgattaggttcaacatttttttttttttttttttggcaagcagatatttggttgtcctgttcttagtaatggtgagcttaatcagtagctgcacagggacaacctcttccctctgtctgctgtcaagttccctattaaccttatatctgatggttttatccaataataaattgtttcctgagtcagttatttcattcagaattgcaaagtgatgatttttagtttagttattccttccatgtttaatggaattcttctgtaatgaagaacttctctcaaagctgccaactagggttgccctaaagtataatatatacaagaaaaatagtaatgcttttctttttaattgtcaaatacagtaaggaatttcagtgaggatgtttgtgtgtgttttggagatggggtcttgctttgttgcccaggctggagcgtagtgacacagtcatagctcagtgcagcctcgaattcctggactcaagggatcctcctgcctcggcctcctgagtaactaggactacaggcaggtagctgggactacatacgtgtaccagcacacccagctattttttaaaaaaactttgtagaattttgaatgagccacagtgcctggctgaggatggtttcgagttaaaagttttcacgctgttacaatttatagtttcacaagaatgtttaaacatcag

SEQ ID NO: 353339 - DNA, 5296 bp, Homo sapiens
  misc_feature (5294)..(5295): n is a, c, g, or t
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagtgactgaagaaatatcaaatgtttcctagtaagacagcaactcaggactctaggatggaagaaggtgtctgaccgtaaattacacctgcagtgcaaccagcagactaatggggatgaggttctggtacaagatgatgaacaccagtatgtcagacaatgacttgggagctggaatcaaggacatgaccaagagcagcaagaacaaaagggagactgacacattgatcactttctcaacctttgatctcttgagaggatggttcacatttgagtaaagacaggggagtttgttttcagaatgacatactagtctgcaggatgaatttcataactgacattgcaccttggactgcaactaggactttcactggaatcagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttattttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatcactagcatccatctctggaactcttttcatcttgcaaaactgcaattctatacccattaaacaatgacccatnnc

SEQ ID NO: 353340 - DNA, 4926 bp, Homo sapiens
  misc_feature (4924)..(4925): n is a, c, g, or t
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatcactagcatccatctctggaactcttttcatcttgcaaaactgcaattctatacccattaaacaatgacccatnnc

SEQ ID NO: 353341 - DNA, 2251 bp, Homo sapiens
ggccaggctggtctcgaactcctgagctcagcccatctgccgtgctcagcctcccaaagtgctgggattacaggcatgagccaccacgcccagcctcatattgttttgactttccttaaggatagtaatcttaaggaattactattccttgagaatagtaatcaaaatttatccggttaaatagtcttaactgttataaaccatattattttataaagcgtcatttttcttggtcgagcaagtgtatagtattgtcgaaatgaaatttaactgtctgccttctttttactttaagaagtacttctctgggtttttgttttcttcctttcctttgtgtaggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353342 - DNA, 2649 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagaattctgcttggtcagaatcgtgatggcattgtgttcagcactgatgactattttcaccatcaagatgggtacagcaaaacagtaaccggatcgagaacata

SEQ ID NO: 353343 - DNA, 2372 bp, Homo sapiens
gttagcatctgtaattgtgtagatttaagtgtaaagtgatttgaaatctgaaatctttgtaagattattcagctcttgtgctggtctgttcgtgatatactttcaggtaagtatcagaaatccatttaataacctttcctgtgtgatttatttcacttggttatatttatttctgatagtttatttctgatggttatagattttgtaaatggcacctttatgatttcttttattaacagaattctgcttggtcagaatcgtgatggcattgtgttcagcactgatgactattttcaccatcaagatgggtacaggtataatgttaatcaacttggtgatgcccatgactggaaccagaacagagaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggtaaaataatagcagcatgggatattttaagaggctttattttatacttgatgagtaaattcagagaactttgaatctgtaccattgttatgtagtcccaaagttatttccccgagaataatgctaatgttttccaaggcttaatatactggttgtgaatattaaaagtttttctcattgatattgctctacaagaaacctacttaatacattttttagcggacatgggtcaatttctgtttatcattaataggggttcttaacctgggctacacttttgaatttcttggggactttaaaaaaagcaaaaaaaaaagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaaccctcataccattaacttgttgcagaaactatgttgtttgtcctgtagaaagttccacatgctgtagttgtctatttgcttcttggtgttaaccatttaacttgctcctcttctttgttttctgtgaatggaaattagctctagattagaggcttgattaggttcaacatttttttttttttttttttggcaagcagatatttggttgtcctgttcttagtaatggtgagcttaatcagtagctgcacagggacaacctcttccctctgtctgctgtcaagttccctattaaccttatatctgatggttttatccaataataaattgtttcctgagtcagttatttcattcagaattgcaaagtgatgatttttagtttagttattccttccatgtttaatggaattcttctgtaatgaagaacttctctcaaagctgccaactagggttgccctaaagtataatatatacaagaaaaatagtaatgcttttctttttaattgtcaaatacagtaaggaatttcagtgaggatgtttgtgtgtgttttggagatggggtcttgctttgttgcccaggctggagcgtagtgacacagtcatagctcagtgcagcctcgaattcctggactcaagggatcctcctgcctcggcctcctgagtaactaggactacaggcaggtagctgggactacatacgtgtaccagcacacccagctattttttaaaaaaactttgtagaattttgaatgagccacagtgcctggctgaggatggtttcgagttaaaagttttcacgctgttacaatttatagtttcacaagaatgtttaaacatcag

SEQ ID NO: 353344 - DNA, 2992 bp, Homo sapiens
  misc_feature (2990)..(2991): n is a, c, g, or t
ggccaggctggtctcgaactcctgagctcagcccatctgccgtgctcagcctcccaaagtgctgggattacaggcatgagccaccacgcccagcctcatattgttttgactttccttaaggatagtaatcttaaggaattactattccttgagaatagtaatcaaaatttatccggttaaatagtcttaactgttataaaccatattattttataaagcgtcatttttcttggtcgagcaagtgtatagtattgtcgaaatgaaatttaactgtctgccttctttttactttaagaagtacttctctgggtttttgttttcttcctttcctttgtgtaggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatcactagcatccatctctggaactcttttcatcttgcaaaactgcaattctatacccattaaacaatgacccatnnc

SEQ ID NO: 353345 - DNA, 1724 bp, Homo sapiens
  misc_feature (10)..(10): n is a, c, g, or t
  misc_feature (18)..(18): n is a, c, g, or t
  misc_feature (64)..(64): n is a, c, g, or t
  misc_feature (67)..(67): n is a, c, g, or t
  misc_feature (73)..(73): n is a, c, g, or t
gcagtttttnttggcccntgtaacatttccaattttgatttggggtgaaggcttctcaaaggtnggngcctgnatgtgtaagaagaaactcatatactggttgtgaatattaaaagtttttctcattgatattgctctacaagaaacctacttaatacattttttagcggacatgggtcaatttctgtttatcattaataggggttcttaacctgggctacacttttgaatttcttggggactttaaaaaaagcaaaaaaaaaaaaaaaaaaaaaaaagaaaaaaacagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaaccctcataccattaacttgttgcagaaactatgttgtttgtcctgtagaaagttccacatgctgtagttgtctatttgcttcttggtgttaaccatttaacttgctcctcttctttgttttctgtgaatggaaattagctctagattagaggcttgattaggttcaacatttttttttttttttttttggcaagcagatatttggttgtcctgttcttagtaatggtgagcttaatcagtagctgcacagggacaacctcttccctctgtctgctgtcaagttccctattaaccttatatctgatggttttatccaataataaattgtttcctgagtcagttatttcattcagaattgcaaagtgatgatttttagtttagttattccttccatgtttaatggaattcttctgtaatgaagaacttctctcaaagctgccaactagggttgccctaaagtataatatatacaagaaaaatagtaatgcttttctttttaattgtcaaatacagtaaggaatttcagtgaggatgtttgtgtgtgttttggagatggggtcttgctttgttgcccaggctggagcgtagtgacacagtcatagctcagtgcagcctcgaattcctggactcaagggatcctcctgcctcggcctcctgagtaactaggactacaggcaggtagctgggactacatacgtgtaccagcacacccagctattttttaaaaaaactttgtagaattttgaatgagccacagtgcctggctgaggatggtttcgagttaaaagttttcacgctgttacaatttatagtttcacaagaatgtttaaacatcag

SEQ ID NO: 353346 - DNA, 978 bp, Homo sapiens
  misc_feature (976)..(977): n is a, c, g, or t
taaaaaaactcaacagaggaggtaacaattggacattttagtgtctaatttgaagatgtatgccatacttgttgatagaagaaagtaaggcacagaaaacttgagtaccttatttttaaacatgttaacacatttgcatgaattagtgcatttatttttaattttttgtaatgtacatagctggatcctcagggaatgggatctagaacaagtttcagctgaaggacaaggagttgggaaatgtcagggaacaggctcttgaatgaggcaggactaagcagtgtagactgtggggacagctgtgaagtcctggatgccaggggagtggcataactcaggaagtaaaggctgggaacctgaaaacaaactgttcatgtcacatgttttctggtcttgtctgggcttgtgtttgcttgtagttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatcactagcatccatctctggaactcttttcatcttgcaaaactgcaattctatacccattaaacaatgacccatnnc

SEQ ID NO: 353347 - DNA, 691 bp, Homo sapiens
ggccaggctggtctcgaactcctgagctcagcccatctgccgtgctcagcctcccaaagtgctgggattacaggcatgagccaccacgcccagcctcatattgttttgactttccttaaggatagtaatcttaaggaattactattccttgagaatagtaatcaaaatttatccggttaaatagtcttaactgttataaaccatattattttataaagcgtcatttttcttggtcgagcaagtgtatagtattgtcgaaatgaaatttaactgtctgccttctttttactttaagaagtacttctctgggtttttgttttcttcctttcctttgtgtaggccataggaaaaggatacagagtagagtttcatgaacctgaaacttggtggaaatttgatcctgaagaattagaaaagtaagacactcgaatttttattgaatccttaacttttcttctttcttttgtgaattctgacatcctttcacagtttattgaatacaaatgtaggttcaggaaactgagggtaaaatgtgaggaccttttttctctggtttttggctaggccacttctctgcattgtccttctgccttcatctccttctcattttaggtcccatcaactttttactttgtgctttcatgttgctcccacttttctatcttttcaactacaggaccgtagtattata

SEQ ID NO: 353348 - DNA, 1281 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagtcagagggggaccaaaggagaaccccaatttaactcttgaaacccaagattgacatggattatcccgttttacacagaaactgaaagcttgactggaaacgc

SEQ ID NO: 353349 - DNA, 296 bp, Homo sapiens
ctcatccatgacatactctacctctgcatccaggcatccaggtggcttctcaatgtagcggtagtaggcagcaggcagcgggggtgcttgtggctggatgcctgagtccaccatacggaagctgggctgtgggaggtggaaggaagtaccagatgcatgcttggagcaggattccttctttttgcccttggatgagggtttcttggacttgccagggaactgactgaagaaatatcaaatgtttcctagtaagacagcaactcaggtgagatggaaactccaagtaatgatataat

SEQ ID NO: 353350 - DNA, 2782 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgt

SEQ ID NO: 353351 - DNA, 4075 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353352 - DNA, 4975 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagtgactgaagaaatatcaaatgtttcctagtaagacagcaactcaggactctaggatggaagaaggtgtctgaccgtaaattacacctgcagtgcaaccagcagactaatggggatgaggttctggtacaagatgatgaacaccagtatgtcagacaatgacttgggagctggaatcaaggacatgaccaagagcagcaagaacaaaagggagactgacacattgatcactttctcaacctttgatctcttgagaggatggttcacatttgagtaaagacaggggagtttgttttcagaatgacatactagtctgcaggatgaatttcataactgacattgcaccttggactgcaactaggactttcactggaatcagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagag

SEQ ID NO: 353353 - DNA, 4181 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353354 - DNA, 4236 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaaccctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353355 - DNA, 4006 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaggtttgttttgggctaagtgtcccaggatagaatatttggctaggagtcaaaagacctagattttattttcagcttaggtttttaccagctgaatgactgtaggcaagccgtttaaatagctttgagacctaatttctccatctgttagaggtggtgataattatacttgccctacctgatcagggtttttgtgaaaagcagagaatttagataaaacgctttgtaaactgtaaatagtttatcagtataagctggtaaaataatagcagcatgggatattttaagaggctttattttatacttgatgagtaaattcagagaactttgaatctgtaccattgttatgtagtcccaaagttatttccccgagaataatgctaatgttttccaaggcttaatatactggttgtgaatattaaaagtttttctcattgatattgctctacaagaaacctacttaatacattttttagcggacatgggtcaatttctgtttatcattaataggggttcttaacctgggctacacttttgaatttcttggggactttaaaaaaagcaaaaaaaaaagacaaaaagtgtgcctggcctcagccttagatattttggtttcattgatctggggtggggcctaaacattgatactttttgttttgaaatttctccagacgattctgatgtatagtcagaattgaaaactgttgatctgaactataagtaaatacatatgctatgttattttaaaagaatggattgatgattaaacaaatagcttttattatgaaaaattttaaacagattaaagagactgtaatgaacctcatagacccatcacccagaattatcaggtattgagattttggtatatgggcttttatctttttgtttgtacccctttctctttttaaagcaaattctagacatcatactttatacatttcaaaataacttttttactaatcacatctttcacttcagtgccgttatcacacatttaaaaaaatgccagttccttcagatcatgtaacccagtgtgtaattgaatctcctctgttgttcgaaaaaatctcttcacagttattttgtttgaattgggatccaaacgaagtcctcaaaatgcattttgttttatttaattaagttaatccatagcatgttccttcttttaaccctcataccattaacttgttgcagaaactatgttgtttgtcctgtagaaagttccacatgctgtagttgtctatttgcttcttggtgttaaccatttaacttgctcctcttctttgttttctgtgaatggaaattagctctagattagaggcttgattaggttcaacatttttttttttttttttttggcaagcagatatttggttgtcctgttcttagtaatggtgagcttaatcagtagctgcacagggacaacctcttccctctgtctgctgtcaagttccctattaaccttatatctgatggttttatccaataataaattgtttcctgagtcagttatttcattcagaattgcaaagtgatgatttttagtttagttattccttccatgtttaatggaattcttctgtaatgaagaacttctctcaaagctgccaactagggttgccctaaagtataatatatacaagaaaaatagtaatgcttttctttttaattgtcaaatacagtaaggaatttcagtgaggatgtttgtgtgtgttttggagatggggtcttgctttgttgcccaggctggagcgtagtgacacagtcatagctcagtgcagcctcgaattcctggactcaagggatcctcctgcctcggcctcctgagtaactaggactacaggcaggtagctgggactacatacgtgtaccagcacacccagctattttttaaaaaaactttgtagaattttgaatgagccacagtgcctggctgaggatggtttcgagttaaaagttttcacgctgttacaatttatagtttcacaagaatgtttaaacatcag

SEQ ID NO: 353356 - DNA, 3145 bp, Homo sapiens
gaaactcgcgcggacatttctgcccaggcttggagagaagagggattcctatgaaatgatattacacatatcacattgtggcaggttgttagtctggtattatatatgcttttaaaattcattagcaaatgacattctcatgcacacgagtgtgtcaaacacaagaagcaagtccagtttataggtagtccatgcactatttgtgtgtgtgtgtgtgtgtgtgtgtgtgtgtgtgtgtgtgtgtgtgctgaacagtcatagcagttgtcgacgcgactcatacgcgttctcgtggacatctgtagtgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353357 - DNA, 4976 bp, Homo sapiens
  misc_feature (4974)..(4975): n is a, c, g, or t
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatcactagcatccatctctggaactcttttcatcttgcaaaactgcaattctatacccattaaacaatgacccatnnc

SEQ ID NO: 353358 - DNA, 2189 bp, Homo sapiens
ctatgattctcgaatcgttatgaatatcaaatgtccatttctattgtaatgaattcagtggaaccatcacacaaaagcacacaaagacctcctcctccacaggggagacagagaattctgcttggtcagaatcgtgatggcattgtgttcagcactgatgactattttcaccatcaagatgggtacagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattag

SEQ ID NO: 353359 - DNA, 2607 bp, Homo sapiens
gtatttatttttaatgcaacaaacacttacatagcgcttattctaccaggagctcgctgttctacttgcttgcacgtattgactcttttaatgggaaagctcagtgattggtctgtatttccaaaaacaaaacaaaacagcgacctgacactaaacgattttgttcataagtatttttatctgttattggggacctgcgccgcagtaattctgtccttccacagaaaagcatgagcctaaaattacgtcaggtggtctttcgtagaaacgaccggaatgcaaatttgtggtaccaactgtggagttccgttggaaaagtcagctggttgtcttctagaaagctctaagaagcatgcactgagagccgattatacatctattggggggcgccagtttctcaaattcctttttccttcgggggtgaacgccagaggaggtcgctgctttcttttaacgaaagttggtgtttttagataacttccctgctccagatctaggaactaattccggtctacttttgttgccaaattactgcgtttgtcacgccatggattctgggagacctagtctccgtgccgtgaggtttacggagccggtgtgaacgtcggacttcaattcccacaatgcctggcgcaaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagtattctgattgcatcagtatcgtcatggaagggttttcaagacatgaacgacgtattaca

SEQ ID NO: 353360 - DNA, 2647 bp, Homo sapiens
  misc_feature (2645)..(2646): n is a, c, g, or t
atcaaattcacacataacaatattaacctcaaatgtaaatgggctaaatgctccaattaaaagacacagactggcaaattggataaagagtcaagacccatcagtatgctgaattcagtggaaccatcacacaaaagcacacaaagacctcctcctccacaggggagacagagtgactgaagaaatatcaaatgtttcctagtaagacagcaactcagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatcactagcatccatctctggaactcttttcatcttgcaaaactgcaattctatacccattaaacaatgacccatnnc

SEQ ID NO: 353361 - DNA, 3549 bp, Homo sapiens
cctgtatgttttgtcatgtccaggtcaagttacagaaaactatgagggtaaaataagttgtcaggagttctttgagggtccagaataaattttaaaccactttttagtgtcatataacctcacatacagaaaagtacataaatataaatatataacttaacaaagttcttacaagatcaacacacgtttagctatcacccatgtcatgggagcattgccagcatctcagaagctctttgcattcctcttcccagtcacagttaccttttattctctaaaggtagccattgttttgcctgggtaatcataatctctttttttaaagttttgccataatatctttggccttaatatcatagtttgggggcaggggcaaggttaaaaaaataccatagtttagttttgccttttatcaaagctttatattatgtataatacatatatatatggaatcctacagtttatatacattgtgtctaatttatttcactcaacattatgtttgtaagagatgttcaaattgtgtctgtaataataatttggtgttgcccattttaaaatgtgatagcaactgtcataaataacttctaaaaagtgatattttacttcaatttttgcaagtcctagaagtccactcaatctttctgtaattcttaaaacagtatttcataatctttaattttgttattaacaaggggatatagtcagcaggctcagtgaataggtagttctatgtgaaaaggatgtaattaacatttttctgtgatatatggaatctttatacctttttaaaatattgataaaaacatttgagtttttaataagtctttttacataaaatgtggacagatgaaatatatattgtttatttacaaaatattatttagaatttgtgtgctttttctctaaaacagttaatctctaagcctgtacattctgcaacaaagatttacaatccttttcttttttgttaggaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagtgactgaagaaatatcaaatgtttcctagtaagacagcaactcaggactctaggatggaagaaggtgtctgaccgtaaattacacctgcagtgcaaccagcagactaatggggatgaggttctggtacaagatgatgaacaccagtatgtcagacaatgacttgggagctggaatcaaggacatgaccaagagcagcaagaacaaaagggagactgacacattgatcactttctcaacctttgatctcttgagaggatggttcacatttgagtaaagacaggggagtttgttttcagaatgacatactagtctgcaggatgaatttcataactgacattgcaccttggactgcaactaggactttcactggaatcagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagag

SEQ ID NO: 353362 - DNA, 3106 bp, Homo sapiens
atttctatgcagagtgttgacctagattaactcttttcttcacaagtgtaccttcaaagtcatctttaaaattaaggggtcatgaatgtattcaccaggattgagcccttgctgctgttttagtaagtattgttatctcgaccccacaaattacaccaattgaccttttccctctcctcccctcccctgccctgtgcccaagccactgcatgaggggcctgagcgaggggctccgaccggagcaagccctgacactcccccatgccagacctgtgcagatcctgacgctcgcccgccagccccgcctcgtcccaggccccaggacttctgggtcagatgaccgacgtgggaatctggtcggtgtgccatatcgccaggcatctccagacagctgaggctcagagagcacaggcctggggccgtcctatctggtggatgggtttctgagcaggtggacatgctgggcctttccagtacaagagcttgattaaagaaaactcacagggcgggaatttattagagatactagcagaggcgttcctttgagatacccgtaccttatatgtcatacggagtcttcactcacacacacaccctcatctttccttaggggtgccaacagttcctgtgtgtaaccagtatataccagggtaactggacctggaccccagggagggggtggtaactgaggccttctttaaaacgtgtggtagcattgaaggcttgcgggagttgtgggtctttcctaggaatggtacattccccaaggtcattagttgcaaatccatcacaagttctttttttcctttcttttcttttttttttttttttgagacagagttttgctcttgttgcccaggctggagtgcagtggcgcaatcttggctcactgcaacctccacctcccgggttcaagcaattctcctgcctcagcctcctgagtagctgggattacaggcatgcgccaccatgcccggcttattttgtatttttagtagacatggggtttccccatgttggtcagactggtctcgaactcctgacctcaggtgatccacctgcctcggcctcccaaagtgctgggattacaggtgggagccaccgcgcccagcccacaagttctaatccatatggaattgttttctttttcctccccgtgaagaccttcagtgggatgagccaagaggctggggactgccgtgagacttagaagggacaccccagagcctggtgctgtctctagctcctcacacagactctcctcctctcctccgggactcactgcagggaatggtttctggggaggcgtgatgaagaggccacttcaggatacattgagtttgaagtgcccttgagacctccagggggtgacatagaggatcttcagggtcagaggaaaggtggctttaggcatagttagcatgaggatggtgaatcaaaatgacaggtgtggggatggacatgggtctgtggacatggatgggtgaggagtcagggccgacaggtgtggacgtgggtggatgagggggcagggctgacaggtgtggacgtggatgggtgagggcagggctgacaggtgtggacgtgggtgggtgagggcagggctgacagatgtggacgtgggtgggtgagggcagggctgacaggtgtggacgtgggtgggtgagggcagggctgacaggtgtggacgtgggtgggtgagggcagggctgacaggtgtggacgtgggtgggtgagggggcagggctgacggatgtgggtgggctaaggggacagcgctgacaggtgtgggcctggtgggcagaggggacagtgctggtggagccccgtgttaacagccaggtggaaaggggcatgtgtgcctgcagctgggaaaggcggaaacccaggagtggagagatttgagaagaggcaccgtaggactgcatatccccggggggtccaggacaggaaagctgaaatgctttttgagtgggggcgtgggtgggtcgtgggtctgtggtggtgtgagccgctgctcctcagagtagtcctggcttccttgttgtgtagcagtaggaacacctttgcattgtcccaaacggaagtagcccaatttgcacactcaatcatatcgtgccctaggacatctcggagagctgatggggctgaagccagcatggtggggcaggagaggtggggtggggggctggaggggaagaggagggggacagagctgcgcccacacaggcaggggctgtggggtaggggctgagttacaaatgggctgagaaaaggaccctcatatagggtgctggaaaacaggagaaagggaaggaaagtgaagttatccgaagtttgttaagcacctttttactgacctttttggggtttttttggtgtagagggtgtgtagaaatagaaaagtaaactccagttctgttggatttagcgcgactggtgcccaggctgcccagctcacacaagctcttctctgggaaaaggagagcttgtcctttgtttgtttgtttgttttaactgatggtttcgttttgtttttttttaagatggagtctcactctgtcgccaggctggagtgcagtggcgcaatctcggctcactgcaacctccgactccctggttcaagcgattctcctgcctcagcctcctgagtagctgggattacaggcatgtggcaccgtgcccagctaatttttgtatttttagtagagacagggtttcaccaggttggccaggatggtctcgatctcctgacctcgtgatccgcccgcatcggcctccgaaagtgctgggattacaggcgtgagccaccgtgcccggccaatgtttttagaacagttataggtttacagaaaaattggatggagattacagacagttcactcccttccccctcaactctcccaatcattaacatcttctatagtgtgttacatttgttacaattaatgaactgatactgatactttattattaaataaagtttagcattaacattagggtttactcctgtgttgtgcggctttggacaaatgcaggagagcaagtcccacccagtgtgctctggagcagccgctggccctaaaccccctgagccatacctccc

SEQ ID NO: 353363 - DNA, 1586 bp, Homo sapiens
atttctatgcagagtgttgacctagattaactcttttcttcacaagtgtaccttcaaagtcatctttaaaattaaggggtcatgaatgtattcaccaggattgagcccttgctgctgttttagtaagtattgttatctcgaccccacaaattacaccaattgaccttttccctctcctcccctcccctgccctgtgcccaagccactgcatgaggggcctgagcgaggggctccgaccggagcaagccctgacactcccccatgccagacctgtgcagatcctgacgctcgcccgccagccccgcctcgtcccaggccccaggacttctgggtcagatgaccgacgtgggaatctggtcggtgtgccatatcgccaggcatctccagacagctgaggctcagagagcacaggcctggggccgtcctatctggtggatgggtttctgagcaggtggacatgctgggcctttccagtacaagagcttgattaaagaaaactcacagggcgggaatttattagagatactagcagaggcgttcctttgagatacccgtaccttatatgtcatacggagtcttcactcacacacacaccctcatctttccttaggggtgccaacagttcctgtgtgtaaccagtatataccagggtaactggacctggaccccagggagggggtggtaactgaggccttctttaaaacgtgtggtagcattgaaggcttgcgggagttgtgggtctttcctaggaatggtacattccccaaggtcattagttgcaaatccatcacaagttctttttttcctttcttttcttttttttttttttttgagacagagttttgctcttgttgcccaggctggagtgcagtggcgcaatcttggctcactgcaacctccacctcccgggttcaagcaattctcctgcctcagcctcctgagtagctgggattacaggcatgcgccaccatgcccggcttattttgtatttttagtagacatggggtttccccatgttggtcagactggtctcgaactcctgacctcaggtgatccacctgcctcggcctcccaaagtgctgggattacaggtgggagccaccgcgcccagcccacaagttctaatccatatggaattgttttctttttcctccccgtgaagaccttcagtgggatgagccaagaggctggggactgccgtgagacttagaagggacaccccagagcctggtgctgtctctagctcctcacacagactctcctcctctcctccgggactcactgcagggaatggtttctggggaggcgtgatgaagaggccacttcaggatacattgagtttgaagtgcccttgagacctccagggggtgacatagaggatcttcagggtcagaggaaaggtggctttaggcatagttagcatgaggatggtgaatcaaaatgacaggtgtggggatggacatgggtctgtggacatggatgggtgaggagtcagggccgacaggtgtggacgtgggtggatgagggggcagggactgcttcagtttcgtcgacgcggccgcgaatttagtagtagtaggggccgc

SEQ ID NO: 353364 - DNA, 692 bp, Homo sapiens
aaggtatctggcttcccctttgccttctgttataattgtaaatttcctgaggcctccccagccatgttgaactggagctgactgtggaggaagggctgcaacaaaccaggggcctggattgtgacatacttacagccacgaagccattgagtaaagataacagtttcttcaaggaagaatacggagtgtggatttcagccatgctgaacagactggggcaccctgaacatttaagttaacatcttcctgaacctctgggctactgtttcccaagatgatagggatctgaggaaggggcgccaatgctgacttgctctgcccctctgtgtcctggctgcctgatggttgtccaaggcggcccagcagctgccccctgccctggtcataagccttttatcacatcacaattgggttctggagcaaggctcatggtccagggaaatcaggtgccccaaactgccccctgttggctcctcatccttcaaacaggtcacagcagggaaagagaacaggcatggtatgctaccctggtaccctccagatgccaccaggaccctgtgggcatagtgcccagagctaaccacttgcacagttgacatctcctagtagactgggggatccaagcgggggaggggggaacttgggctgtcctattaacagctgtgacccctgccaggcgcagtggctcacac

SEQ ID NO: 353365 - DNA, 654 bp, Homo sapiens
cctaatgctaaatgacgagttaatgggtgcagcacatcaacatggcacatgtatacatatataacaaacctgcacaatgtgcacatgtaccctaaaacttaaagtataataataataaaattaaaaaaagataactgtgaaagacaaattataaattttttgtcagttttatgatgtaaataaaagtaaaatgtatgaaagcaaggatagcaggttgatatgaaagtataccattgtaaaatttttataaataaaataatagtatttaaggtagactgtgttaatttaagatgtatattataaactctagcacaatctctaaaacaatacaaagatgtatagtcagtaaatgcaataggggacataaaatgaaacccaaaatgtaatcaataaattctgaatgacaagagaaggagggggggccctgaaaacaaatttcaagggaaattaggaaattatatgaatgggattaaaaataaagacacagcatagtgaaatttgcgaaatgcagctaaagttgtgtttagagggaaatttttagctttagttgcttacattagaaaagaaaggaggtttcattgataatctaaacttccaccttaagaagctgcaaaaagagtgaattagacccaaagtaagtaaagggaagaaaat

SEQ ID NO: 353366 - DNA, 1303 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgt

SEQ ID NO: 353367 - DNA, 540 bp, Homo sapiens
catctccctttcctctgtcctccatccttctcccaggatggtgaagggggacctggtacccagtgatccccaccccgtcgggtggagcgctccacccgacggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccccgtcgggtagagcggtaagccctgaagtcggtcagggtgacctctgcgttctctgggcagacgtcgatccgatcgatgacctggtcctggtcaaagtcagactcacagatgtctcccaccccgtcgggtggagcggggatcctctag

SEQ ID NO: 353368 - DNA, 438 bp, Homo sapiens
  misc_feature (122)..(122): n is a, c, g, or t
cccgactagcccgacaggagcctccctcccgcctcagtgctctgagccaagctcaccagatgcagaggacagagaaggtgctcttgccttgtaggacaaagccagtctgatctaagcacccncctgtcgggctagtcggggctgtcgggctagtcggggccccgactagcccgacagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcgggctagtcgggggggtaccgagctcgcaattcgt

SEQ ID NO: 353369 - DNA, 437 bp, Homo sapiens
  misc_feature (433)..(433): n is a, c, g, or t
ccaactctcccaggtcaagcagcagccccgcagacaagcaggcagagtcttcatcatgcctccaattctggagtctttgcacgcctcggtcagcgggcaaccctgtgcccgcgcgctcctccctggcgacgccgccactgtcgggctagtcggggccccgactagcccgacagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtgtcggctagtcggggggatcctctaatcacncacc

SEQ ID NO: 353370 - DNA, 972 bp, Homo sapiens
catctccctttcctctgtcctccatccttctcccaggatggtgaagggggacctggtacccagtgatccccaccccgtcgggtggagcgctccacccgacggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgt

SEQ ID NO: 353371 - DNA, 875 bp, Homo sapiens
ctggggcgcgactgggtgccgggagccggccgcgccccagcgagactggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgt

SEQ ID NO: 353372 - DNA, 919 bp, Homo sapiens
ttggttggacgaccgtggctctgacggagagaagtccctatcccacacctggcctgtcacgttccctcccctttccccaggcggagtactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgt

SEQ ID NO: 353373 - DNA, 1370 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggagtccgctgcattaatgcagcggactcggcatagtggggtggctgtgggctcccagcctggcccctgggaaccgtgggagcacagggacaagcacatggctatggaatgcagggtgacccaaggacaagcgagttgcgggatctctactgtgaccatgcagaatgatcgcagtccgctgcaatt

SEQ ID NO: 353374 - DNA, 1219 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcgggctagtcgggggggtaccgagctcgcaattcgt

SEQ ID NO: 353375 - DNA, 1090 bp, Homo sapiens
  misc_feature (1086)..(1086): n is a, c, g, or t
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcggctagtcggggggatcctctaatcacncacc

SEQ ID NO: 353376 - DNA, 1125 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgccgagtccgctgcattaatgcagcggactcggcagcccaggatggtgatagcaggcagcagcttcccgtcctt

SEQ ID NO: 353377 - DNA, 844 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccggagggttaaggctcacaggagggttaaggctcacggagggttaaggctcacggagggttaaggcatc

SEQ ID NO: 353378 - DNA, 1023 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgacggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgt

SEQ ID NO: 353379 - DNA, 1477 bp, Homo sapiens
gaaaaccctggactcagactgggtccttctgagctggaggtaccctctgagagcagggggacaggcggccactccaggagtgcctgctgctgttttccttgcccctccaaacccaccctccaatcagctctgcagacccctaactcggtgctggtgatgggcctggctctcccgcacccaatcctgcctgcacttctctttcctgaattgagacatgactgtccacctggccctgaaccttcttcgcctgtcgctgcccatgccccagtgagtgtccctgccatagccctgctccaggctcgacacccctctctgtacctcccacccccgcgtcgccatagtccctgtccctcagggctctattcctaccccactcccgcggatcaagacccagtgaccccacaagaacccccctgcttcgcccccaggagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgt

SEQ ID NO: 353380 - DNA, 1163 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgt

SEQ ID NO: 353381 - DNA, 1442 bp, Homo sapiens
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgttcagagggtgccgggggagggagtttgggtgcacaaggcctccgcttgcaacttgaacaagcctccttgggccaaaccagaaaccaacaatcgggggctggtggggtgaagtggaggggcacctaggttgaaacccacc

SEQ ID NO: 353382 - DNA, 1239 bp, Homo sapiens
  misc_feature (1203)..(1203): n is a, c, g, or t
  misc_feature (1235)..(1235): n is a, c, g, or t
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcacgttccctcccctttccccagcgcactgttgagggcagcctctccagctctcttgtttatgcaaacgccgagcgcctgggaggctcggtaggaggagtcttccacggccccgccccgcccctgtcggtgtcgggctagcggggntgtcggctagtcggggggatcctctaatcacncacc

SEQ ID NO: 353383 - DNA, 1107 bp, Homo sapiens
  misc_feature (1071)..(1071): n is a, c, g, or t
  misc_feature (1103)..(1103): n is a, c, g, or t
ctccacttctccccgcccaccctgccggaggctgctcctgattggcttcccggccgcggggctcaggttacattcgcgagcggagccgagcgcgggagaccggacccgagagcagagctgctgtttcggcgcgggtcggctggcggccgactgccccagagcccccacccggcaccacacagaccccacccccgccctgcgccagccttcgtccccgcagaggaccccccgacaccagcatggactgctgcaccgagaacgcctgctccaagccggacgacgacattctagacatcccgctggacgatcccggcgccaacgcggccgccgccaaaatccaggcgagttttcggggccacatggcgcggaagaagataaagagcggagagcgcggccggaagggcccgggccctggggggcctggcggagctggggtggcccggggaggcgcgggcggcggccccagcggagactaggccagaactgagcattttcaaagttcccgaggagagatggatgccgcgtccccttcgcagcgacgagacttccctgccgtgtttgtgaccccctcctgcccagcaacctgccagctacaggagccccctgcgtcccagagactccctcacccaggcaggctccgtcgcggagtcgctgagtccgtgcccttttagttagttctgcagtctagtatggtccccatttgcccttccactccaccccaccctaaaccatgcgctcccaatcttccttcttttgcttctcgcccacctcttcccgcacccagcatgcagctctgcctccgcagcctcagtgcgctttcctgcgcgcactgcggagggcgccctaagcgtcacccaagcacactcacttaaagaaaaaacgagttctttcgttctgtgcgcagctaaaaggggcgccctacatctccgtgccactcccgccccagcctagccccaagactttggatccggggcgagatgaagggaagagggttgttttggtttcggacgacccttgctctgaccggaagagaagtccctatcccacacctgcctgtcgggctagcggggntgtcggctagtcggggggatcctctaatcacncacc

SEQ ID NO: 353384 - DNA, 302 bp, Homo sapiens
  misc_feature (6)..(6): n is a, c, g, or t
tcccgnatagcccgacagtcagttttgcaggagattcagcactagtgtcttcctgtcacgttccctcccctttccccagcgcactgttgagggcagcctctccagctctcttgtttatgcaaacgccgagcgcctgggaggctcggtaggaggagtcttccacggccccgccccgcccctgtcggtcccgccctcccccccgccgggctcctggggctgtggccgaaaggtttctgatctccgtgtgtgcatgtgactgtgctgggttggaatgtgaacaataaagaggaatgtccaagtgt

SEQ ID NO: 353385 - DNA, 401 bp, Homo sapiens
ttttttttttggtctggtcacacagtgtttagcatagtatcatatcatgcttgctcattaagcaattcaaaaatacttgtctgattgaacttaataaagtaaaaggaaatgagagataacaaagcaaggtgaccaaataggtgagttattatttattaactcacaaatgatattttccttggatttatctggggaagaaaactcagtgcttaaaattgtatacttttgccagtaagttcaacctagctttctacttattctcagataatgcctgctttcgagtgaacagccttcaaacttgtcacagtcttagtaatttttttctatccctgaggaatattttattggctggaaagcagctgaaatgttgacttttatttgactttacctaaatggtaatt

SEQ ID NO: 353386 - DNA, 5568 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctc

SEQ ID NO: 353387 - DNA, 4020 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagagtcttagagagcctccttgtgtctctggtaaccaccgtggtggtgtttgtggcctcgatggtgttaggagaatgccgacagatgtcctcttcgagtcaaatcggtaatagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctc

SEQ ID NO: 353388 - DNA, 574 bp, Homo sapiens
agcggacttggaaagctgacagcaaggtgctttctgagccccagttactcttccacctccccttgcctgaaggggccacagcccagaggctcagcacccacctcatggcctctgtgactatgacagtcactcttgagaggaagaaatatctgtgtcagggcaaggaggcttctctcttcccagcatcctctgcctcttcccggcgttgggtcctttgtgggtgcgccaccctcctgcactcctccttttcccttcttggggggcgcgatattttccagaggctttccctgaggagtggtcccatgaggtagtccgtggagcctactccacgctgtgttctttcggtccaacccggaggctctgagagctacacctgtggttcagtgagtcagccagatgtgtgattccagcccttggctgcagacaggtgagcattctctaagtgcggtcggccatccacatttgtgggtcctgcatccatggaattacgtagggtcaaccaactgtggagcaaatatattcaggatgcaaaacataaaaaagaacaagacaacagtaaaaaataatgcaaata

SEQ ID NO: 353389 - DNA, 788 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatataaattccagatgaagatgtaaatatgcagaacaaaacttcgggagactatatgttgtcaagagtggggaataatttcttaaaactccagaaggcacagactataagaaaaaacatcaatggggccggacacagtggctcacgcctgtaatcccagcattttgggaggcagaggcaggcggatcacaaggtcaggagattgagaccatcctggctaacacggtgaaaccccgtctctactaaaaatacaaaaaaattagctgggcgtggcggtgtgcgcctgtagtcccagatgctggggaggctgaggcaggagaatggcatgaacctgggaggcggagcttgcagtaagccaagatcacgccactgcactccagcctgggtgacagag

SEQ ID NO: 353390 - DNA, 6542 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttagatgggatgatcacaactccatggcaacaagatgacacgaatgcagcagagaccccaggggacaggagcctcttgcagtctgtccctaggcccagccctgcttgtcctccctggctgttatcttcggtaccggaagctgttacagcccagtccgctctgggctccaatcctgtccatcctgcccccgaagcagctggatctccgcaggctccgaggggcagtgagcagcgccctcagcttgctttttaggagggcagatcgatcagaggagtcccaggggccccgcccgagggcacctccatctctctgggctgggctgacttccccggtccagggaggcacctcagggagggggctgagagcagcccccgcttcttcattcggctcactgagcacttgtgggggcacgacctcatcttctaaaggcatcttttcttccaaatggtccagcaaattcttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaacccttccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 353391 - DNA, 5837 bp, Homo sapiens
agcggacttggaaagctgacagcaaggtgctttctgagccccagttactcttccacctccccttgcctgaaggggccacagcccagaggctcagcacccacctcatggcctctgtgactatgacagtcactcttgagaggaagaaatatctgtgtcagggcaaggaggcttctctcttcccagcatcctctgcctcttcccggcgttgggtcctttgtgggtgcgccaccctcctgcactcctccttttcccttcttggggggcgcgatattttccagaggctttccctgaggagtggtcccatgaggtagtccgtggagcctactccacgctgtgttctttcggtccaacccggaggctctgagagctacacctgtggttcagtgagtcagccagatgtgtgattccagcccttggctgcagacaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttagatgggatgatcacaactccatggcaacaagatgacacgaatgcagcagagaccccaggggacaggagcctcttgcagtctgtccctaggcccagccctgcttgtcctccctggctgttatcttcggtaccggaagctgttacagcccagtccgctctgggctccaatcctgtccatcctgcccccgaagcagctggatctccgcaggctccgaggggcagtgagcagcgccctcagcttgctttttaggagggcagatcgatcagaggagtcccaggggccccgcccgagggcacctccatctctctgggctgggctgacttccccggtccagggaggcacctcagggagggggctgagagcagcccccgcttcttcattcggctcactgagcacttgtgggggcacgacctcatcttctaaaggcatcttttcttccaaatggtccagcaaattcttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaacccttccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 353392 - DNA, 2016 bp, Homo sapiens
tacagtggactgggtcctgaaagtgtcccttccagctgggaactcttaagttaatcaaggtcaggagcaaatcatccctcagcacaaggtcccaaagccagggccgggggcccattggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttagatgggatgatcacaactccatggcaacaagatgacacgaatgcagcagagaccccaggggacaggagcctcttgcagtctgtccctaggcccagccctgcttgtcctccctggctgttatcttcggtaccggaagctgttacagcccagtccgctctgggctccaatcctgtccatcctgcccccgaagcagctggatctccgcaggctccgaggggcagtgagcagcgccctcagcttgctttttaggagggcagatcgatcagaggagtcccaggggccccgcccgagggcacctccatctctctgggctgggctgacttccccggtccagggaggcacctcagggagggggctgagagcagcccccgcttcttcattcggctcactgagcacttgtgggggcacgacctcatcttctaaaggcatcttttcttccaaatggtccagcaaattcttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaacccttccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 353393 - DNA, 6659 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttagatgggatgatcacaactccatggcaacaagatgacacgaatgcagcagagaccccaggggacaggagcctcttgcagtctgtccctaggcccagccctgcttgtcctccctggctgttatcttcggtaccggaagctgttacagcccagtccgctctgggctccaatcctgtccatcctgcccccgaagcagctggatctccgcaggctccgaggggcagtgagcagcgccctcagcttgctttttaggagggcagatcgatcagaggagtcccaggggccccgcccgagggcacctccatctctctgggctgggctgacttccccggtccagggaggcacctcagggagggggctgagagcagcccccgcttcttcattcggctcactgagcacttgtgggggcacgacctcatcttctaaaggcatcttttcttccaaatggtccagcaaattctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaacccttccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 353394 - DNA, 4126 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctc

SEQ ID NO: 353395 - DNA, 369 bp, Homo sapiens
accccaggggacaggagcctcttgcagtctgtccctaggcccagccctgcttgtcctccctggctgttatcttcggtactgcaaagagaacacagacatatctggcttggtgacctggctgtcctggaaaagtcagcttcatgtatgagtgtgcccatcctctgaacttgattactgaccacctgcttcccaccggcccccaccccagcctgatgaccctctgagcttcatgaattgataagcaagttactcatcagagtaaatttcacttaagcccttcaggatcttgcaattctggggaggaatatgaactgctaatcagccatgcaaagataacttggctctatgaatattttaatttcccagtgc

SEQ ID NO: 353396 - DNA, 434 bp, Homo sapiens
aaatcggggctgggggtaggcagggttatgttttgaatttctgagaccagagcttctttctgtggcgttgtaacagctgtgctttgcctcctagagtcttagagagcctccttgtgtctctggtaaccaccgtggtggtgtttgtggcctcgatggtgttaggagaatgccgacagatgtcctcttcgagtcaaatcggtaatgactcattccagctccaggtaaccccagtgcacctgctacctttatcccataccacgaggaagaatccagaaatgtatgaccttcctctgttgagaactaatagatatgttgggttcatccttccacacccattacctgagcgttgagagatatgggaatctgtagtcgtctttttacctcagagaaagtgcacaccacatgccctgtgtctttgccacttctgtgaacaa

SEQ ID NO: 353397 - DNA, 402 bp, Homo sapiens
gctgtttatcccaatcaagctgtgtctggctgtgcactatccaggcctccacattctgtgacaaactaacagggccggctcctgtcactcctgttctcgccagcgggttttaccctgaaggtgactcaggccttctctttgccctagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttga

SEQ ID NO: 353398 - DNA, 3911 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctc

SEQ ID NO: 353399 - DNA, 3885 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctc

SEQ ID NO: 353400 - DNA, 6709 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttagatgggatgatcacaactccatggcaacaagatgacacgaatgcagcagagaccccaggggacaggagcctcttgcagtctgtccctaggcccagccctgcttgtcctccctggctgttatcttcggtaccggaagctgttacagcccagtccgctctgggctccaatcctgtccatcctgcccccgaagcagctggatctccgcaggctccgaggggcagtgagcagcgccctcagcttgctttttaggagggcagatcgatcagaggagtcccaggggccccgcccgagggcacctccatctctctgggctgggctgacttccccggtccagggaggcacctcagggagggggctgagagcagcccccgcttcttcattcggctcactgagcacttgtgggggcacgacctcatcttctaaaggcatcttttcttccaaatggtccagcaaattcttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaacccttccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 353401 - DNA, 6683 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttagatgggatgatcacaactccatggcaacaagatgacacgaatgcagcagagaccccaggggacaggagcctcttgcagtctgtccctaggcccagccctgcttgtcctccctggctgttatcttcggtaccggaagctgttacagcccagtccgctctgggctccaatcctgtccatcctgcccccgaagcagctggatctccgcaggctccgaggggcagtgagcagcgccctcagcttgctttttaggagggcagatcgatcagaggagtcccaggggccccgcccgagggcacctccatctctctgggctgggctgacttccccggtccagggaggcacctcagggagggggctgagagcagcccccgcttcttcattcggctcactgagcacttgtgggggcacgacctcatcttctaaaggcatcttttcttccaaatggtccagcaaattcttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaacccttccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 353402 - DNA, 6686 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttagatgggatgatcacaactccatggcaacaagatgacacgaatgcagcagagaccccaggggacaggagcctcttgcagtctgtccctaggcccagccctgcttgtcctccctggctgttatcttcggtaccggaagctgttacagcccagtccgctctgggctccaatcctgtccatcctgcccccgaagcagctggatctccgcaggctccgaggggcagtgagcagcgccctcagcttgctttttaggagggcagatcgatcagagggcacctccatctctctgggctgggctgacttccccggtccagggaggcacctcagggagggggctgagagcagcccccgcttcttcattcggctcactgagcacttgtgggggcacgacctcatcttctaaaggcatcttttcttccaaatggtccagcaaattcttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaacccttccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctca

SEQ ID NO: 353403 - DNA, 5689 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtgaattcatctcctcctgctagcagccgcgtcctggaggagcagcggatggggaatccattctgtttcttcctggtgtttaggaagttgccccacacacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggctgttccatcagtggtcgcagccagttcagctcctgcatccatccccaagtgttctgagtggaatttgaggcctccccaaccacctaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggtgctgaagtttattcactttcaaaccactttcagtaacagttctttagaaaaggaaaatacagggaaagggataaacctcactgacttggaggaaatcaagaggagtgagcaca

SEQ ID NO: 353404 - DNA, 4679 bp, Homo sapiens
tggctgggagggggttggtagaggggtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcaaaaaaaaaaaacaagaaaagaacaacagcgggggccaccaaaagatatacccaggaggagcaccacaggactacccactaacacgactgtgaccagagagggacccaaataagagcaaataatagagcaaggacacgcgacgacacacaacacagacggacgtggaaacgcgacacggccacatgacaagaacatcaagggggagacaaaggagcgcaacaccaaaaaaacataaagagcagggcacaaacaccacaggcaaccgggcgcaccacggccataagcagacgaaaacaaacaacgcacagcgaagacaataagaggatgccacagaagaaagagacacgatcgccagaagccagaacaacgaccgagaccaagccaacgagaacagcagagaaagatacagagaaaaagaaagcaaccagcacgacaagctgaacccgcagagtccagctctacaaggaaaaaagaccagcagagagaggacgaaacgcagaacagcaaaacgacgacgaacacacagccaaagacacaacaacaacaaagcgt

SEQ ID NO: 353405 - DNA, 579 bp, Homo sapiens
cggcgtctctaagctaggtaattactgggcgcgtcggtccatacatgggaccagcgtgggcgggcgggcgcgttctaggcccgggctgccaaagctccatcctcccttctcgtccttcagcgaggcccaggagggactccagaagttcaaggtggtgagagctggtgtccacgccccagaggaggtggggcctcgcgaagcaggtgagccccctcttccttctgcagaaccccttcccagtgtcaaagacaaaatgcaaattatggagatgatttaaattaggtttttgcgataagagagagcatcccagagcagaagaacagaatgtttttgtagggtggttttgccttagacttttataggaagtagagaaattgttggtgagttgctttacactgggaatagatttacaatcacatacatttcagtcagctgaacagaaaatatttatctgtgtgtctagctagtttcagagggacaaacttctaatcccagttaatcatcctgagacaaagaatggggagttggaacgtctatgtctggtctgttggcatgttcaggtacaatgggtaagatcag

SEQ ID NO: 353406 - DNA, 2234 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccactacccaacttttgtgttttttgatcattatttgtacgtacagttgaatgtatccagctgtcacatgattctgaatttgggtttgtaactgataaggcaatcagggaattctccagcattttcaagaacctctgtggtttcagttgaaatgtccagtgagtcatgtccagcttttccaccatcctcccacgtgctgtatgtcggttaatgctgcccttttgttttgctaactcccagtgtaaacctaatgtaatttgggggttttcattctgtttcgtggacattactgtcaatacaccagtaccacattgtttta

SEQ ID NO: 353407 - DNA, 1866 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgca

SEQ ID NO: 353408 - DNA, 1897 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacgggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353409 - DNA, 2124 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggtgtcctggaggccaagaagagaaagtgtttcctggagcgagtgatccaatgtgtggtcagccctgctgctgaacaggaggccgaagacgagagctgcccggaggactgggcagcagctgttccagcagagacatcagcaaaagccatctagaggtggatccagagtgtggactaacagagaaaagaagtggagggagagcaggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353410 - DNA, 1805 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353411 - DNA, 1124 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353412 - DNA, 1921 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353413 - DNA, 1802 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353414 - DNA, 1944 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatgccctgctgctgaacaggaggccgaagacgagagctgcccggaggactgggcagcagctgttccagcagagacatcagcaaaagccatctagaggtggatccagagtgtggactaacagagaaaagaagtggagggagagcaggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353415 - DNA, 2005 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagttcctcacagtctacgtcaggctcaagcaagcttccgggatggtgtcctggaggccaagaagagaaagtgtttcctggagcgagtgatccaatgtgtggtcagccctgctgctgaacaggaggccgaagacgagagctgcccggaggactgggcagcagctgttccagcagagacatcagcaaaagccatctagaggtggatccagagtgtggactaacagagaaaagaagtggagggagagcaggcctgcagctggccgcagacatagccagcctccagaaccgcattgactggggtcgaagccagctccggggactccaagagaaactcaagcagctggagcctggggctgcctgacatgcgcgcaaagaggcagggcagcgagcacagctgttctccgacatggctacgtgatctcaggccttcttccttcacaattagctcttgcccctaccccacgccagctaatgccccttctgtgtccctgctctgcatgtttccattttccttaggtgtgaagtttgaagaggcaaacagtaattttgaaagccactactttgaaaccattctaaggcctgagttcccataggacacactcacataggcaggtacacgttagtcaacaattggaactgcctcttggatcactcagctgtgctttcatggctggatgatggaacactgtgcgaagagagatgggggccaggaagtagcgcttcatgcttagtacatcctccaaattgtctttgctggaggagaaaaccgtactcagccaaaagatcaggacaatatgacttgagtccacaaggacacaaacacctgagtagctgggcagcccttggcagggtctaagccaggaagtaaaaatgatctggcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353416 - DNA, 1243 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccacta

SEQ ID NO: 353417 - DNA, 1556 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgaggcccaggagggactccagaagttcaaggtggtgagagctggtgtccacgccccagaggaggtggggcctcgcgaagcaggtctgcggaggcgcaagggccccactaagaccccagaaccggagtcctctgaggcccctcaggaccccctgaactggtttggaatcctagatatttaagggaactctaggaagaggcctaggtttttaaaatcctgtctctttgtcttaccataagaggctgagcctctcttcatttttttgaagggccacttgtgttttctgttctgggaacttcattcatttttctactgggttgttgatctttgcagtaatttctaggagctgtttatgtttggaggtaattggtcctttgtccatatatatgagatgtaagtcttattttccagtttatctttttgcttattttttttgactttttattgtaaaataaaacatcaaactgcacagaacagttgaatagcttaatgaataactacagtaaaagctatggtaaccactacccaacttttgtgttttttgatcattatttgtacgtacagttgaatgtatccagctgtcacatgattctgaatttgggtttgtaactgataaggcaatcagggaattctccagcattttcaagaacctctgtggtttcagttgaaatgtccagtgagtcatgtccagcttttccaccatcctcccacgtgctgtatgtcggttaatgctgcccttttgttttgctaactcccagtgtaaacctaatgtaatttgggggttttcattctgtttcgtggacattactgtcaatacaccagtaccacattgtttta

SEQ ID NO: 353418 - DNA, 1269 bp, Homo sapiens
ccgccgtgcagaatgcagttttcagatgacgaaccgctaaaacaatcataattagcggctggaaacagttcaactgtaaaaaccgcacaccgactgaaggttgcttgccggctcctttccaaattaactttaaaaccactcttccctcaaccaaaatggtttctgtagagcttcgccttcttccatcgccacaacagtggcgcgacttctaagattcggcagcttccggaaggactcagaaccacctataaccctagccgacagttcagcaggctgatccacttgggggctaattggagaaaccagttgattggttgcttccgtgctgcttctctaagggcgcttgcccttaaagaagctgacccagaggccttggtgctgccggcgtggggatccccagatgggaacgccccttgatggaggatctcgtgtgcctattggctgtcctgccaaactgcggagggtgacaaggaagaaggtggctccagatctggaggtgtgtccatggcggcgcttgacctgcgagcggagctggattcgctggtcctgcagctgcttggggacctggaggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccaggtgaggaagcttccatgctgggctgggtgggcgggcgggcgcgttctaggcccgggctgccaaagctccatcctcccttctcgtccttcagcgaggcccaggagggactccagaagttcaaggtggtgagagctggtgtccacgccccagaggaggtggggcctcgcgaagcaggtgagccccctcttccttctgcagaaccccttcccagtgtcaaagacaaaatgcaaattatggagatgatttaaattaggtttttgcgataagagagagcatcccagagcagaagaacagaatgtttttgtagggtggttttgccttagacttttataggaagtagagaaattgttggtgagttgctttacactgggaatagatttacaatcacatacatttcagtcagctgaacagaaaatatttatctgtgtgtctagctagtttcagagggacaaacttctaatcccagttaatcatcctgagacaaagaatggggagttggaacgtctatgtctggtctgttggcatgttcaggtacaatgggtaagatcag

SEQ ID NO: 353419 - DNA, 445 bp, Homo sapiens
tttttcccctggatttttcaaggtacttccttgaaaatgattcccactgcacatctcttagaataaaataaaccttcaagataattttttaagaaaactgagcccagtaactgttctttcctaaaggggaggggcaactagtgtgaaaatactagtaacaatttctttttcctgaatgcccatttctataaatgttacaagcacatctatagaaacacattctccctttctcttttcactctcattcttaaaacaatcctaaaacagacattataatccacgttgtactgggaaaatggagtgctggcaagggcaaacagctaggaagtgaaggaggcgggatctgggccccagctgctaccactccagcttctccctgttctgctctgcagactgcatctcatgccacatctgtgccatgcagtttggatgtaaatattaggaa

SEQ ID NO: 353420 - DNA, 815 bp, Homo sapiens
gaacaacgtggcaaaatcctttaatccaaaaatgtaacattaactaaacattaaattatagatacaagactgtttggtcaactcttgatgtgacaaaaactgagaagggaaaactcatttttctgattttttattttcatttctcttctagactacttacgaaatgttttgttttaactggtcttaggtaaggcacagacattaatatcttttaaaaggtacctaagtgattgtggtgaactgttagtgttgaaacccagtggtgtggaaccagccttccctgtgtccatcaacagaatcactgggcccccagtcacccagcctcggctccagcctcatccatgtccccatccatgaccccatccgggctgctgctggactgctgcaatagtctactcataattggggctttcctagtccatcctacctgttataaaagtgtgactaaagaaatgatcattgaaaacaataaaccaacacaggcaaactatacatttatataaatgtttttcttttaaagggagaaccatttaaccccattcaggggctagtggcttgctttaaatatattgccacgtatcttcagaacttttctgtggaagccagatctctctgcatgacttgagttttggtgactgactcctgtgagaatgagccatttccaagttcactgtcatttgcagccaacagatctactggatgagtcggagtgagcaaaaaatcattacaaagcaagtgtggcatgagatctgtacttagtgtagtacctgaaagacttccaaataattaccttccagattcttaaaaaatttaaa

SEQ ID NO: 353421 - DNA, 1623 bp, Homo sapiens
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattc

SEQ ID NO: 353422 - DNA, 812 bp, Homo sapiens
tatctgtgtctgaagcaggaggcttgagatgatttttatggacacaccaagaaataactgcattcagaaacaggtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattc

SEQ ID NO: 353423 - DNA, 1659 bp, Homo sapiens
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagactacttacgaaatgttttgttttaactggtcttagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattc

SEQ ID NO: 353424 - DNA, 508 bp, Homo sapiens
tcagtgacaggcatctgttctgttttgttctgtatcttatagagtagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattc

SEQ ID NO: 353425 - DNA, 381 bp, Homo sapiens
acaccaagaaataactgcattcagaaacaggtgaaattcccaacgatgatgaaaagaaaggactacagatgggaaaattgtgtgtgattacattagtatctcttcctgaaatgagggatacattgatagagatgattaaagccaacagtaatcgggctagcttgccgagtgctagaagtcagtatttcacagatgggggtccgtttcttttgcatgtcaagaaggtttacttagcatgttaccagcagaactagtccagttgtagctcagtttttcctaagcagtgggaaaggctgcttatcctgtctgaaagcaggggttggagaaggagaattttcttagaatttaacaacacaatctgagactgaaattcttgactgg

SEQ ID NO: 353426 - DNA, 174 bp, Homo sapiens
aagtttgcaatctacctgtaaatgggtgattagaagataaagattataattatgggggttttatcatccaatgttacagtttttcaggaatattcttacaagtttcttgacatttttatttatagataccctatattaatcttgtgaagcatttaacatctgcctgtccaaatg

SEQ ID NO: 353427 - DNA, 268 bp, Homo sapiens
tcacgatgacgttattgacgatgcaagttctcgaagaggaaaacacacagttaataagatctggggtgaaaagaaggtatggttttttggtttttttaaaatctctcttactgaatcacacacttttcggaccgcatttgtttctcagatttgtctcattaaaaatatgcttgctcaaatgtaatgtggtcttctgaatttcaaaaaagtattcatgtcttgtccaaatacagatatttgataaataaataataaaaaataccatgga

SEQ ID NO: 353428 - DNA, 1773 bp, Homo sapiens
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattcaaatggtttgtcttgatttaccgtaggagtaaaggtcagaaaaatgtgaagtctgcattgaagtccacatgagttatattttaacagtatccaaaatttcatataggagaatggtttattataaaagactgtacataaaatttagacaac

SEQ ID NO: 353429 - DNA, 1706 bp, Homo sapiens
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgatccgatgtccagttttcacaagctgattgctgagaaggttctaggcggcgtctgttaaaaagcattgctttctgttaattagacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagagtgatggtgtgcaacaaacaacctacctcgcccagcagtactgccatgaagcaataagagagatcagtaaacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaatttatttttttttattgcaaaagttttttcagaaaactttttaaatgtaattaataaaccacctgaatctgtcattctagtcctataaattataatcaaggtatcttgatggttatatgtggtattgtttacactgttaatatccacatgtaaggccattacacaaataaataaccaatgttaaaattc

SEQ ID NO: 353430 - DNA, 1824 bp, Homo sapiens
atcgcgggccagaggcggagccgccgccctgccgcgactttcagactccgaccatggcctcgcgctggtggcggtggcggcgcggctgctcctggaagccggcggcgcggagccccgggcccggctcccccggccgtgcgggaccgttggggccgagcgccgctgccgaagtccgcgcgcaggttcataggcggaagggacttgacttgtctcagataccctatattaatcttgtgaagcatttaacatctgcctgtccaaatgtatgtcgtatatcacggtttcatcacacaaccccagacagtaaaacacacagtggtgaaaaatacaccgatcctttcaaactcggttggagagacttgaaaggtctgtatgaggacattagaaaggaactgcttatatcaacatcagaacttaaggaaatgtctgagtactactttgatgggaaagggaaagcctttcgaccaattattgtggcgctaatggcccgagcatgcaatattcatcataacaactcccgacatgtgcaagccagccagcgcgccatagccttaattgcagaaatgatccacactgctagtctggttcacgatgacgttattgacgatgcaagttctcgaagaggaaaacacacagttaataagatctggggtgaaaagaaggctgttcttgctggagatttaattctttctgcagcatctatagctctggcacgaattggaaatacaactgttatatctattttaacccaagttattgaagatttggtgcgtggtgaatttcttcagctcgggtcaaaagaaaatgagaatgaaagatttgcacactaccttgagaagacattcaagaagaccgccagcctgatagccaacagttgtaaagcagtctctgttctaggatgtcccgacccagtggtgcatgagatcgcctatcagtacggaaaaaatgtaggaatagcttttcagctaatagatgatgtattggacttcacctcgtgttctgaccagatgggcaaaccaacatcagctgatctgaagctcgggttagccactggtcctgtcctgtttgcctgtcagcagttcccagaaatgaatgctatgatcatgcgacggttcagtttgcctggagatgtagacagagctcgacagtatgtactacagactacttacgaaatgttttgttttaactggtcttaggtaaggcacagacattaatatcttttaaaaggtacctaagtgattgtggtgaactgttagtgttgaaacccagtggtgtggaaccagccttccctgtgtccatcaacagaatcactgggcccccagtcacccagcctcggctccagcctcatccatgtccccatccatgaccccatccgggctgctgctggactgctgcaatagtctactcataattggggctttcctagtccatcctacctgttataaaagtgtgactaaagaaatgatcattgaaaacaataaaccaacacaggcaaactatacatttatataaatgtttttcttttaaagggagaaccatttaaccccattcaggggctagtggcttgctttaaatatattgccacgtatcttcagaacttttctgtggaagccagatctctctgcatgacttgagttttggtgactgactcctgtgagaatgagccatttccaagttcactgtcatttgcagccaacagatctactggatgagtcggagtgagcaaaaaatcattacaaagcaagtgtggcatgagatctgtacttagtgtagtacctgaaagacttccaaataattaccttccagattcttaaaaaatttaaa

SEQ ID NO: 353431 - DNA, 1306 bp, Homo sapiens
  misc_feature (127)..(129): n is a, c, g, or t
tatgaattcggaagaacaagaatggcgacaatgagaaaaaggagagagcagaagaggaaacaaacctcagggaagaatgtctgcatgacgaactctagaatgcgcccttggagggtatgtaagatannnagttcattctctttctcctctctccaccgctccatctctccagggtctctaccttgcctgtcaggctccactttcctttgctcctgccttttgcatctgttcctctctgcattctcccctcatctcctctcttccgtgcacctcattttcctgctcccctcctgcctctgtccctcatcttcttttcagagacttaaaaccagccagtggccactggcttttcagtgtctcctcctcctccttgaactacctcttccttctagtgcttctgtccttccctcctcctgacctccagtgaacaataattatttgtaacgtaatgacaaattatcgttacgttacaaagaccagaggttagaggtggtgattggccttgtaaactgtaggtcagcgatgagtaatttaagaaaactaaatttaattggtttactcatgagtcagttaggaattctatttggcagctagaacagaaatagcagtggcttaaaccagtagaaattttttctattgtgaaaagaaatctagggggacagtctagggcttgtctctccgctctgccatccttagtgcagggcgtccaaccccaaggttgtatcatggtctaagatggctgcgggagccccaaccatcatgtcaggttctaggaagaaagcaggaagaagagaggaaaggcaaaaagaacacatgctccatcttaaggagctttcctgcaagtcccaccaaatagcttcagcttctcctccttgcctccattagttgcaagggaggctgagacatcatttagctgagcacattgctacctgaggtagaattgggattctgtcaccaagaaagaaggggagaatggatattgtgtaaacaattagcaaggtctgccgccattcattcaacattaatttagcacctacaatctactagttatgaagaacagtcaaggtgccccattccagagggaagacatagataagtaaacaagtacagtacacaggatggggcccacattccgcttcctgatgagcctggttaaccaagtaccgaaaatagttcccgatgactttgagaccatgctcaacagcaacatcaatgaccttttgatggtgacctacctgggcaacctcacacagtcacagattgcactcaatgaaaaacttgtaaacctgtgaatgggcccaacatt

SEQ ID NO: 353432 - DNA, 359 bp, Homo sapiens
gcggccgcactggagcgcagctttcccgctagaactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagaggtgcagatgggactcccggcagggcaagggcgtgctggaggtggggggcctagatgtagggagccggcgtagccccacgtaaggggtggggccgtggtttcaggaggtggctggcctgcaggggtcgggaggtcctaggtt

SEQ ID NO: 353433 - DNA, 2700 bp, Homo sapiens
gtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353434 - DNA, 2532 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353435 - DNA, 2039 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353436 - DNA, 2085 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccagccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353437 - DNA, 2022 bp, Homo sapiens
gtaagagcagccagacctggagggcttgggtaaaaatggctgaatatttagcttcgatattcgggactgagaaggacaaccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353438 - DNA, 2262 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccagccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353439 - DNA, 2490 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353440 - DNA, 2532 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccgggtgagaatccgagaccgagccttgcttgggcggagcttgcagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353441 - DNA, 2241 bp, Homo sapiens
gtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353442 - DNA, 2111 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353443 - DNA, 2676 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagtatacaattagcactgaagtacttcttgaagtacaatcctaattgggcaaagacccaacagatagcctcactgctcttcgccctagaagggcctattccaacatacacacagggccacatgtgggagggctgaccccaggtgcctctgggccaccagaatcccctctgggaaacaaccctgctacaga

SEQ ID NO: 353444 - DNA, 2356 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353445 - DNA, 2171 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccgggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353446 - DNA, 2963 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcagagagatggggtttcaccacgttggccagcctggtctcgaactccggacctcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353447 - DNA, 2482 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagtatacaattagcactgaagtacttcttgaagtacaatcctaattgggcaaagacccaacagatagcctcactgctcttcgccctagaagggcctattccaacatacacacagggccacatgtgggagggctgaccccaggtgcctctgggccaccagaatcccctctgggaaacaaccctgctacaga

SEQ ID NO: 353448 - DNA, 2668 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353449 - DNA, 2052 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagaggtgcagatgggactcccggcagggcaagggcgtgctggaggtggggggcctagatgtagggagccggcgtagccccacgtaaggggtggggccgtggtttcaggaggtggctggcctgcaggggtcgggaggtcctaggtt

SEQ ID NO: 353450 - DNA, 2059 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccgggtgagaatccgagaccgagccttgcttgggcggagcttgcaggtgatagggagcggggaaggggcgaggtctgtgggctacgggccagagaggcttgcttaggggtctaagcggtgggccttatgcagatcagacagggatggcaggcagagcctgtgcagatagtgcgggctaccgtagggcaacagcgaatggatatggctggagaggcgggataggggccgcgtggaaagggtgggctttatgtagagaagccgggagtgggcggagcttcgtgcggagcaggctggaggggggtgaaaaggcgagcccggagaaaagtgacaagaccgg

SEQ ID NO: 353451 - DNA, 1901 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccagccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353452 - DNA, 1776 bp, Homo sapiens
cccaaaccagcctgaacccctaatccacgaccagcctggattgccacccctgatactggccactgagttcccctgatactggccactgaggtcgtgtcttagaactctagttatttcagcaccctcctgcctcatcccagagcagagaggcaggcctgcaggatctctgcaccactcctcagggttctaacagaactctcaacgctcctattcccaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353453 - DNA, 1591 bp, Homo sapiens
tggacttctggcccccagaactgtaagacaatacatttctgtggtttaagccacacagtttgtggtgctctgacttcgtgagcttttctgcccatctgatagcgcctgcctgccttccgccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353454 - DNA, 1348 bp, Homo sapiens
ggctcaagtgatcctcctgtcttggcctcccaaagtgttgggattacaggcatgagccaccacacccagcccctgctttacttctaatgacggttctaattctccacaataaccctatgagacaggtgctatcattgtcttattttagggatggaaaagggagggtgggtgggtgaggacacggcagaggtgggatatgcattcttgcaatctagatccgcagccctgttagtcccctagtggccttgtgggcttctctgataaccggctcagttgggggatgagggctcgggggtagattcccggcttccgaagaggcgtgagaattctgttcccccacatcaccgcgtcctttcttctgcccgatttccccggaaagtgtagcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353455 - DNA, 1089 bp, Homo sapiens
ggctcaagtgatcctcctgtcttggcctcccaaagtgttgggattacaggcatgagccaccacacccagcccctgctttacttctaatgacggttctaattctccacaataaccctatgagacagcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353456 - DNA, 1722 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctggagtgcaaaggcgcagtcttggctcagtgcaacctctgcctcccagagagatggggtttcaccacgttggccagcctggtctcgaactccggacctcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataatgtaatctgttcagcatggagaccttcttctaccgcccctgttttaataaagctgggtgtttcccttcggcatca

SEQ ID NO: 353457 - DNA, 1425 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtacctcaggaccagcctgctatgtctcctcatgtcctaaggcccctatatcctcagatgagcctaaccctaagccccagtaaccacgttcccaagaatcttttttttttttttttttttttgagatggagc

SEQ ID NO: 353458 - DNA, 1346 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctggagtgcaaaggcgcagtcttggctcagtgcaacctctgcctcccagagagatggggtttcaccacgttggccagcctggtctcgaactccggacctcaggtaatccacccatctcggcctcccaaagtgtggggattacaggcgtgaaccactgcgcccggtcattcccaagactcttataccctaagagtagttctgagctccatctggagaccagtacctaagt

SEQ ID NO: 353459 - DNA, 982 bp, Homo sapiens
gcggccgcactggagcgcagctttcccgctagaactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353460 - DNA, 214 bp, Homo sapiens
cggggtactggggtcctgggtggtggggcggtgtttctggggtgcccagcttccccggccctcggttcacctttgtctttgcaccttttccagggttaactgctctttttactttaagatcggggtctgccggcacggggaccggtgctcccggcttcacaacaagccgacattcagccaggtgagacccggcacggagcctcgggggttaacg

SEQ ID NO: 353461 - DNA, 2675 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353462 - DNA, 1997 bp, Homo sapiens
gtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353463 - DNA, 2852 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353464 - DNA, 2955 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctggagtgcaaaggcgcagtcttggctcagtgcaacctctgcctcccagagagatggggtttcaccacgttggccagcctggtctcgaactccggacctcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353465 - DNA, 2491 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353466 - DNA, 2296 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353467 - DNA, 2910 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaaggtgcttgctgccccccacttagggcccagaagtggaggcgtttcaatgcctgatggtggccactgtaggctctcagcttgaatttcatcactaaatccagtccagccccagagcgggtagtgagtcccctgaagatctctgagttctcctgctgaccctgactgacatttcctgcagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353468 - DNA, 2357 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccgggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagtatacaattagcactgaagtacttcttgaagtacaatcctaattgggcaaagacccaacagatagcctcactgctcttcgccctagaagggcctattccaacatacacacagggccacatgtgggagggctgaccccaggtgcctctgggccaccagaatcccctctgggaaacaaccctgctacaga

SEQ ID NO: 353469 - DNA, 2297 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagtatacaattagcactgaagtacttcttgaagtacaatcctaattgggcaaagacccaacagatagcctcactgctcttcgccctagaagggcctattccaacatacacacagggccacatgtgggagggctgaccccaggtgcctctgggccaccagaatcccctctgggaaacaaccctgctacaga

SEQ ID NO: 353470 - DNA, 2461 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagtaaaaaaaacaaaaaaaaacaaacaaaaaaaaaaaaaaaaaaaaccccggggtttttttctggggggggggaaaaagggggttaaaaggggcggggcaagtgtttcccggccccccttttttgtcacacagggggaaaatcgggggggccccccatagaggggcgga

SEQ ID NO: 353471 - DNA, 2287 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353472 - DNA, 2055 bp, Homo sapiens
gtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353473 - DNA, 1634 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccagaccatagtgctgctcaacctgtaccggaatccacagaacacagcccaaaagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatcaaaacttgcttttgctgtggtttggcatttccctccacccacacatgtgacgaaaaggggaaacaagactgggtcctggccacaacttcagctgaggaacttggcacggccagcttgggacccaggaccctaacgcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggactatgagttccgggaaaactgcggactcaatgaccacggcgatttcgtaacgcccccgttccgaaagtgttcttctgggcagtgcaaccccgacggcgcggagctatgtagcccctgcggcggcggagccgtgacccctactcccgccgcgggcgggggcagaaccccgtggcgctgcagagagaggccggtccctgccaaggggcactgccccctcacacctggaaacccaggcgcccctagctcccaggagcgcagctcaccagcaagttccattgcctggaggacccctgagcctgtccctcagcaggcctggccgaatttccttccgctcgtggtgctggtcctgctcctgaccttggcggtgatagcgatcctcctgtttattctgctctggcatctctgctggcccaaggagaaagccgacccctatccctatcctggcttggtctgcggagtccccaacacccacaccccttcctcctcgcatctgtcctccccaggcgccctggagacaggggacacatggaaggaggcctcactacttccactcctgagcagggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353474 - DNA, 969 bp, Homo sapiens
ggctcaagtgatcctcctgtcttggcctcccaaagtgttgggattacaggcatgagccaccacacccagcccctgctttacttctaatgacggttctaattctccacaataaccctatgagacaggtgctatcattgtcttattttagggatggaaaagggagggtgggtgggtgaggacacggcagaggtgggatatgcattcttgcaatctagatccgcagccctgttagtcccctagtggccttgtgggcttctctgataaccggctcagttgggggatgagggctcgggggtagattcccggcttccgaagaggcgtgagaattctgttcccccacatcaccgcgtcctttcttctgcccgatttccccggaaagtgtagcagaggcgctgtgtttggaagtcccgctatcacggccccccagatggggcctggacgatgcctcctgacggccttgttgcttctggccctggcgccaccgccggaagcctcccagtactgcggccgccttgaatactggaacccagacaacaagtgctgcagcagctgcctgcaacgcttcgggccgcccccctgcccggaactgtccagtctggcgtcacaacccctgtctcgcctcctggatgagctggaggtgctggaagagctgattgtactgctggaccctgagcctgggccaggtgggggtatggcccatggcactactcgacacctggccgcaagatatgggctgcctgctgcctggtccacctttgcctattcgctgaggccgagtcgctcgccgctgcgggctctgattgagatggtggtggcaagggagccctctgcctccctgggccagcttggcacacacctcgcccagctagggcgggcagatgcattgcgggtgctgtccaagcttggctcatctggggtttgctgggcttaacacccaataaagaactttgctgactactaagcccagta

SEQ ID NO: 353475 - DNA, 1209 bp, Homo sapiens
gtaagagcagccagacctggagggcttgggtaaaaatggctgaatatttagcttcgatattcgggactgagaaggacaaatcggggtctgccggcacggggaccggtgctcccggcttcacaacaagccgacattcagccaggtgagacccggcacggagcctcgggggttaacggctccctggcccttccccttctggggccgtcgtcaccatgtcccgcctattccgggttcctgagtccctccccaccgcccggctttttttctcattggacctttctgcaggctcctcccaccggtcttcgtgccgttttcccgggaacttggtcgcgcccccatgcgtacaggctacacacggcggctgttcatctttgccagtcccttccatcccgctgttcatccttgccagtcccctccatcccttttctggtttcttaggggcaaaggatcgccgatgcactcatgatgcttaggctggggtgtaaggttccacccccaaccttcatgcctcactctctgttcatgcagccctgccctctgagctcaggccccgccccttttaaattctgtgcagaccatagtgctgctcaacctgtaccggaatccacagaacacagcccaaactgcagacggatcacactgtgagtaagggaccaggcctgggggcaaggtgaacagcccccagtaggctacactctgattccaccctgcccgcccccaccccaggtcatgtgagtgacgtggaggtgcaggagcactatgatagcttcttcgaggtgagggttggtaggggcagatggggtttcttgtgggagctcagctgagttcctccccgtcttccacaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggctggagtgcaaaggcgcagtcttggctcagtgcaacctctgcctcccaggttcaagcaattctcctttctcagcctcccaagtagctgggat

SEQ ID NO: 353476 - DNA, 373 bp, Homo sapiens
gtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccagaccatagtgctgctcaacctgtaccggaatccacagaacacagcccaaactgcagacggatcacactgaggtgttcacagaactgcaggagaagtatggggagattgaagagatgaatgtgtgcgacaaccttggggaccacctcgtgcagttcagtctgctgccccccacttagggccgtagccactgtagctctcagcttgaat

SEQ ID NO: 353477 - DNA, 3137 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353478 - DNA, 1004 bp, Homo sapiens
taccttcgtaagaaataagcatcctagccgagacttgattatttggttcaaatatttttaaagattgtagcactgaagtccatagtttaaaggcatgtgtggatttgttagggacaaaatcattgcatattagctttaaatattctcctacaaataaattacggcctaaaatacagacaccaccacaacggtcaaggcatgtaatgaaaacaatgtggggaaagaaatgaaatataataagtaatttagctattccaaagagacctaagctatgaccattttttaaaaagaaaagctatgttttagtttccagcaatgaaaagaatcatggtgtagtggggctctcatgtgaatcttaagtctccctcttcccacctgagtaatgctaagcaagatgtgtactcctcccctctcacacttggactttctagtgtataaaatgggagtaaaacctaccttgcactacggttgtcaggattaagttactcatttcacagtaccaagccccctgcagggtacatggagagatctataagtgctacgttttctttctactgtcatctgaaatgtcagacaggattgaaaattatgtgaaatccaaataccctaaattggcataactaaataccagagaaatagataaattaacagtccactctaccaactgaaagactgctgggcagaaaaaataaaacaacaaactgagacaattaacatattctctaatatatgagaactcaaataaatcatggaatttgcattttttgaaggctaaaaatatagtcattaaactatgtcttttctaggtcacaaatgcctgtaacattaattaagtaataaccatgtgtcaggtgctgagctaggtattttagagggattttattatttcatcctcactagcaagtgacaaagccaggatttcaacccagtaatctgatgccagaactcctaatcatcatgttacctgcctacccattaataaaacgtgagtttaaaaacctcat

SEQ ID NO: 353479 - DNA, 1019 bp, Homo sapiens
gaattgagcgggagttatgaggtgtgccgttcctgtaaaacatggaggctcagaacctaaaaatagcgtaaatgcctatttgactagttctagcagctgacacgcactgaagcattggatagcgctctcgtagttggcattatatggaccctatgtccagcatttccggatacctactcggtctcggtctattatactgcttggatgactctatgtaatcattggcaaagtatgagtccctatactctgttaaaaaaagctcactgttaaagtatagggagaatagtaatccctcatgaatcccagctagattccaatttgggttactaaattgtattttaatcattttgtaatttcagtatggctctttgttctcaaacacatacataccaccacgcacattcttttaaacagctgccacacctcacctccaacagaatgccaaaaatgaaatgttaaaaaattttgtctaatgaagggttacggcttggaacacttggttattcatgttatgtaaatcaagaagtgcatgccatcagcaaattaaaatgtggactggctttgaagactgttaatgatgggtcaggctttgtacttacaagagtacctccttggctttcctgaaataagcatttcttaatcgtaaccctgtcatttttttaaaagagaatttctttaagggccgttttcatgatttttgaagatcaaaatagattatcaaaatagggaacagcaaaaggagggaggctgcccactaagaactattcctcaagcaagtttcctactgattttcttataattattctaaaaatttttaaactacactatggcaacagaattcatttgtaaatcctagcttaatcaggtattttcataattagatcctaaggttttcctttaaaactatttccttatctcacatacagacatgtttctattcaacgttcttcatgccacaaataggattttttaaaaaagtgatatctattaaatacataattcagctgcactgctataaa

SEQ ID NO: 353480 - DNA, 5148 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgcctttggggatttatgaggattttttttggtggggggagggggctccaattcatatctctgaaacccttcacacttggtttactaattcaaagttagaagtctagaatttgccctgccctaacagaaacagattaggaatttgtctacacaaactggtgtcacctgtttcttgactgggatttggtttcctcattataaatatgggaggtagaacagagatctccaacgtctctcccatttatcacagtaattttcttattcacagtaatcattgttggatgttaccttttcagcttcacattctcaagatggtaaaaatcatgtatatagattatcagaactctaagcaaagatgactgtcacatctgaagctgaggtgccttaggtactctactgaccttgatgggtttggagttccccattgcttatcaagagctttttaattgctttggttctttagtttttctttttgcaaaaatccttcctgtcactttaactaaaaaccaaagatttgttttctattgataagcagactagagaaaaactgccttattttcagaagcatgtcttcattcaaagcttaggcttcaatagaaattcagactaatcactgaaatgactatttcaaactagtgaaatatctgggaaataaactgcttcaaaaatattttactgacatgaattttgctagtgaatacaaatacactgcctcaaataaggccatgtatgaatgaacttacaagatatttgagttaatcagtgtttgcatatagagaattagttctaaagttcttaaaaataaatttaggggctccctgaaattttatttaatactttgctaacttacactcttgttttatctccacaggtacattttaggttagctcatggtgaattctatttacaataagtggagcttggattaatgggttttgttatgaattatcttagtgactttagacactgtttccatttgatttttaactatttaaaataccaaattaaataccagtttgttggttgttacttttaaatgattgttactttaacagtgtcccttcttaacacatggggttacaaataaaatactatgcatagtttactatctacgtaaagcactgaactttttaccttagtagtttttatttattaccctatgtaaacatttaggataatactctttcctctatttatgctgagagtctactaatcattggcaaagtatgagtccctatactctgttaaaaaaagctcactgttaaagtatagggagaatagtaatccctcatgaatcccagctagattccaatttgggttactaaattgtattttaatcattttgtaatttcagtatggctctttgttctcaaacacatacataccaccacgcacattcttttaaacagctgccacacctcacctccaacagaatgccaaaaatgaaatgttaaaaaattttgtctaatgaagggttacggcttggaacacttggttattcatgttatgtaaatcaagaagtgcatgccatcagcaaattaaaatgtggactggctttgaagactgttaatgatgggtcaggctttgtacttacaagagtacctccttggctttcctgaaataagcatttcttaatcgtaaccctgtcatttttttaaaagagaatttctttaagggccgttttcatgatttttgaagatcaaaatagattatcaaaatagggaacagcaaaaggagggaggctgcccactaagaactattcctcaagcaagtttcctactgattttcttataattattctaaaaatttttaaactacactatggcaacagaattcatttgtaaatcctagcttaatcaggtattttcataattagatcctaaggttttcctttaaaactatttccttatctcacatacagacatgtttctattcaacgttcttcatgccacaaataggattttttaaaaaagtgatatctattaaatacataattcagctgcactgctataaa

SEQ ID NO: 353481 - DNA, 3078 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353482 - DNA, 3691 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgcaaaaaaaaaaagaaacaaaaaaaaataacaacaaaaagagaacaaacaataaataataaaacaataaaaaaacaaaaacaagaaaaagaagaaggggcggggcgcgggcataataaaagaatacctcccggagggaggccgccatattagtaggcgcaacaccacagttttttgttagaaaaaaggggggcgccccacatagggagggaggcttaattataaaacacgagcagacggcgcgggccgggttaaaaaaacaccgtggcgagcggggagaaagacaaacctgtgtagcgcggagatcacttctgggagagaaagcgacccccaactctgtggaggcggggagagccaaactatggtggggcggcaaccccctcctcaaggagagaattattagcccgccgaggcgggggaaacaaaatacacttgacagtgcggtgtgtctgggggggttcaacccaaccaccgtcgatattgcattgaggctgtgtaaagagaactatgttggtgcaccagagaattccttgctacaggaataattatacaacggg

SEQ ID NO: 353483 - DNA, 3078 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353484 - DNA, 2768 bp, Homo sapiens
tctctgctcaaataccacatcctcagtgtgatcttgttccttgactgctccaggcatgctcctgcatcaggatctatctgcctggagctcttcccctaggtatccctcactgctcaaacttccccattgagaagcctccccggacccccactaccattgtcctcagcactccccgcctccctcactctgctttttccccacagcatttgcaaccatctgctctgtattccctcccctgtgcctcttacccagcagatgtcagcacatgtggacgccacacagcagggactctgctctttcgttcagttcactgacatatccccaggacctaaacagtgcttgacatatagtagatacccagtaaatatgtggtgagtgaaataatttttcatagaaagtctggaaggacatatactagtattttaaaatcccctctggggttatgaacatggatgatgaatgtattctttttgcatagctgtattttataattttctttataatgatgtgtttatgtcatgccaattgtataaacatgatcttatatatttgtgattttttttctccctcccagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353485 - DNA, 3082 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagatatggtataaacgaattacaacagtaaactattacacatttccaacttgc

SEQ ID NO: 353486 - DNA, 2565 bp, Homo sapiens
tctctgctcaaataccacatcctcagtgtgatcttgttccttgactgctccaggcatgctcctgcatcaggatctatctgcctggagctcttcccctaggtatccctcactgctcaaacttccccattgagaagcctccccggacccccactaccattgtcctcagcactccccgcctccctcactctgctttttccccacagcatttgcaaccatctgctctgtattccctcccctgtgcctcttacccagcagatgtcagcacatgtggacgccacacagcagggactctgctctttcgttcagttcactgacatatccccaggacctaaacagtgcttgacatatagtagatacccagtaaatatgtgataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353487 - DNA, 2980 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctca

SEQ ID NO: 353488 - DNA, 2626 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctacctggccaggtagacctaacccaggtaacctacataaacgcagcaagaaacttaagacataaaaaccatgggaaagctcactgtaaaaatattatcaaaatatttctacataagaattttgctttcatttttagttagtctaccaggggtac

SEQ ID NO: 353489 - DNA, 2155 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccataccttgcactacggttgtcaggattaagttactcatttcacagtaccaagccccctgcagggtacatggagagatctataagtgctacgttttctttctactgtcatctgaaatgtcagacaggattgaaaattatgtgaaatccaaataccctaaattggcataactaaataccagagaaatagataaattaacagtccactctaccaactgaaagactgctgggcagaaaaaataaaacaacaaactgagacaattaacatattctctaatatatgagaactcaaataaatcatggaatttgcattttttgaaggctaaaaatatagtcattaaactatgtcttttctaggtcacaaatgcctgtaacattaattaagtaataaccatgtgtcaggtgctgagctaggtattttagagggattttattatttcatcctcactagcaagtgacaaagccaggatttcaacccagtaatctgatgccagaactcctaatcatcatgttacctgcctacccattaataaaacgtgagtttaaaaacctcat

SEQ ID NO: 353490 - DNA, 1079 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagatggatctccgagatgaccccaaaacttagcaaggcctgaagtgcgactatgagcactgaccaagacgctactagtgtgtggaaacaagggcacacgagaaacttagctcaacacgagcataacggagccatgctggctatgttgcgcactggtcccagtcttaaacccaaaacagggcattgcacacactgtgagtagaatgaggccatcatcataagccatttaaactcc

SEQ ID NO: 353491 - DNA, 709 bp, Homo sapiens
gtgtggtgcgtcgggcgacaggtacgtaaggtgaagatggtgcactagcctctgtgatccctagtgacaatcgatggctcattgcacgtaagtgagttggatgtcctcgaccgatctaaatcaaaacagctaggcggtcagcgatcacgcttcgtgaggcgaaatccagaatgcgtcgcttagtgagtcttatgaacatgggatcgtaatcaggcaggagtatcaagcgagtgtcgggtcattcaattttaagcccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagaggtaatggaacactcacagaatttaagcatgaatgtaaaagatgctaagataacaatagaagctaattttattgtgtatttactgtgtgccaggtggagtgctttacatgcattatctcatttaatccttgcatgaactcagtgaggtacgtctgtttcccctgttacacagaagagacagtggaggctgggagatgtcagataattcgcccaagatcctgcaggtaa

SEQ ID NO: 353492 - DNA, 2872 bp, Homo sapiens
agcgggctcctgctcccggcacttcctacccctcggcgccctgggccgtcctccttgaccttcccacatcccctttcctactgccccaaggccccgggggaaatattcgaggggaccgagcgagacgtggctacgggacttgggagaagggggtggacggctggggaccacatcacaccccggccctttgccggttcacagtgagctggccgcacgggaaaagggggtgacatctcgcggggagcgcccccacgcctctagctgggttgggagaggagggtccgggtggggagcgaaattgccccagagcccaggtcactgtgagcttctctccccgcccccacttctgtccttgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353493 - DNA, 2876 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353494 - DNA, 3083 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaacccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353495 - DNA, 3020 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacaatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgccaaaagtgtaataaggtcataactgcatttatcatgaacactaaaaatgtacacattttagttaatgtgcattaaactgtaacaaggcttctggcaattgtagatttagtttgacgctccccaaagtgcatgagacacatgctaaaattacaaattaaaattttgggtcagactttgccataatgatagactcaatttagctctctgaactagttggtaattttttttttttaattcccactttggctgtgtacatcaaatgaaatgagaagtgtgtatgctgaccaaaccacaagaaactttctttaagttgtgttaaagaggaaagacctagaatccaagcgtgttacatgaaaattgtaacagagcagctgcttccacctttcagatatagatgttggaaccacagcagaagttatagagcgacaacttatatacacacctagaatgtaagttaaacaaaataccggcttccagagaccccttttctccagccatattacatcaggctagaagtaattaatgttgatttatttcatctacaagcagttggtccctaagtgaaaggctctgcttgaaaaaaaaaagaaaaaaaagttggaggaaaattttcatgttcttctgtgaagcttatttggtacactggagccatttctaatctttctctggggggaacaggccacagaactgtgttagaggtgaaccatcttaattactagttctattacctaattcagcttccttgtttggtctgctgtggatctgccttattgcatatgccatgcatcagataatggatgcatcagataatggtgttagacaaagcttcattgtgaacaacctaatgcattttagagaaacaatctcatcacattttttctagcctttcctacatttaaacttgctgttgcccaaattataattttttaaatgtctttggtgggcttctgttaattcacatgacttgagcttatagctatgtctactgcacagattgggtaatggaacactaaacttttatacttgaaaatgacagccttaaatgctcatatcagtcacaaatctaggatgtactgtcttgttgtatgtgagctttgtagagatttttaaaaatataagcatcaccttcccattgaagagtggagagagtctactggatgactggccaggaactttctctctgaatcggacatttggatgtcttctttcttccaagaaatggtggttcacattaaagtatcatggccttatgtatgctcaaatggaatcttatgtaactttcttatttaattttggtctgcttatttttagataaaattgaaaggaattgtataaatcaattaacatattagctgagttgtccaacacatggtataaacgaattacaacagtaaactattacacatttccaacttgc

SEQ ID NO: 353496 - DNA, 1720 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcagtcagcgtcaccgtggggggcaagcagtacctcctaggactctatgacacggccggacaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagagataggagcatgctgctatgtggaatgttcagctttaacccagaagggattgaagactgtttttgatgaggctatcatagccattttaactccaaagaaacacactgtaaaaaaaagaataggatcaagatgtataaactgttgtttaattacgtgagaaacatcttcagtggccaaggaaactgtccatttctctcagaaagcaaatgaaatgctacagctatacccagaccttttataggtaatgaagcagttcaaaacttgaaagaaaacaaaacctgtcctcagaattctataaagtgtattaagaatgttccttaaaggtttaagaagcagtaagcagcatctgaagccacaatctattataaatactttatttcaactagaaggtacaatctctcaggggtttcatagtttaaaaagctacaatcacatcatgttgtaactacgtaaaaaacagagctgtaaatggaactgcttggctttgaccatacacatttctgcccagcccttacagaatctgcacaaagaaatatctccctttgctccagttaattgttcttgtatgtaagttgctttctattccagtatatccagagtggtgaaataacaaggccagccacgtagccaaaggtcgctccaagcgtacaggagatgggccatacctgaggagagaatgtatgagatcaaaaaagaacaaatgttttattattacttgagcacaagtgtaacctaaatatttctatattaaagcttaatgtgctttcttaaagaatgc

SEQ ID NO: 353497 - DNA, 1111 bp, Homo sapiens
cgagagccgggtgcacgcgccggggaggtagccaacagccgttgggacgcgacgctggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtccgcagccgccgcacgtccccaaggcagtgagggcaccgcaccctcaaggaaagccaccacacgcccacccccaaagcccacactcccaccccccaggcgggctggggctgagcccggggccggggcgggggctccggggggaccatgcccggaggccggccggcagcagcatggctcacgggcccggcgcgctgatgctcaagtgcgtggtggtcggcgacggggcggtgggcaagacgtgcctactcatgagctatgccaacgacgccttcccggaggagtacgtgcccaccgtcttcgaccactacgcaggaagactatgaccgtctgaggcctttatcttacccaatgaccgatgtcttccttatatgcttctcggtggtaaatccagcctcatttcaaaatgtgaaagaggagtgggtaccggaacttaaggaatacgcaccaaatgtaccctttttattaataggaactcagattgatctccgagatgaccccaaaactttagcaagactgaatgatatgaaagaaaaacctatatgtgtggaacaaggacagaaactagcaaaagaggtaatggaacactcacagaatttaagcatgaatgtaaaagatgctaagataacaatagaagctaattttattgtgtatttactgtgtgccaggtggagtgctttacatgcattatctcatttaatccttgcatgaactcagtgaggtacgtctgtttcccctgttacacagaagagacagtggaggctgggagatgtcagataattcgcccaagatcctgcaggtaa

SEQ ID NO: 353498 - DNA, 539 bp, Homo sapiens
  misc_feature (205)..(205): n is a, c, g, or t
  misc_feature (211)..(211): n is a, c, g, or t
gcggctgctctatgaggatcccctcggtctacattgtcttgtgtgttggtctggagatctgtgtctcccggtcccaatactccggccctcctgctctatccatggcgcccggggctcgtcctcggactcgcggcgtcgttgtcgaacctcacgaactgggtgtcgtccacgtagcccactgcgatgaagcggggctccccgcgtnctgtgncgggacaatggcggtgtagaaatacctcatggagtgggagccggcccaggtctcggtcagggccactgccccccagagcagcaggaggagggttcggggcacctgtaatccgagctctcctggaggctgaggcaggagaatcgcttgaacctgggaggtggagtttacagctgggatatactgacttgatcatagctcactgcaacctttagctcctggactcaagcaatcctccagcatcagcctcctgagcagctgggactataggtgtgaattaccatgcctggctaacttttttattttttgtagagacagggtcttaccctat

SEQ ID NO: 353499 - DNA, 368 bp, Homo sapiens
gttggccaggctggtctcgaactcctgacctcaggtgatctgcccttctcggcctcccgaagtggtgggattataggcgtgagtcaccgagcctggccccaggcaataatataccagtgggcaagaaaatattcttgctctcatgggacttctgttgggggtcagggtatagggaggaaggcatagagatgaaaaccagtaaatatctttctggtttactagggtattcttcaaaaaaagagaaaagattaaagctgcacagacatgatgatgtaaaagctagtagcttctcaagctgtgaaaggtctgtggtgcagagaatagctccctgtgagctgaattttgtttgctgtgggtgcagcatgggt

SEQ ID NO: 353500 - DNA, 1429 bp, Homo sapiens
tggactctttattattttgtatttggattatttctttaaagagatcagagataaaaatatcattgttttgccagtttgctaccaccagcccacacccctcttcccgttgtccaaaaagggggtggttagagttttcttgagtgactgggctattatgattagcagattactaaagctgtgtgattttaacaagacgtaaacacatatgggaacccctccttccatatcttgctaatgtcaattagcaacatattaatcttgctaatgtcaatcctgtcacttcatacatttataaatattagggacatttaaaagagttgtcggactgtgcgggaccttggcacactgctgacggctgcacactcatcactgcggggctcatcacacattgacaccagcaccatattttgctgggtttcctgatctcggttgagtatttggatttgaatgggatggttttaatgttgctactgactactacagtgatccaaataaactttaaagctggggcctccacgccataggcaaattttcataccagttgcctttacctcagtagttttcagctggggcaattttgttccccaggagacatctggatacagtgttggttgtaacagctgggcagggggtacttctgtcatcatctcatgggcacagggcagggatgctgctagggcaacccctcaccctcccaaagaattatcaaaaacatcaacagtgccaaagctgagaagctcagctttaatgtgttcattgagcaactaaagaatagactcagatataggaaagtatttatttatttatttatttagagacagggtctggctctgttgtccagatcataactcactgtaaccttgatctcctgggctgaagcaatcttctcaccttagtctcccaacactttgggaggcagaggcgggcagatcacctgaggtcaggagttcgagaccagcctggccaacatggtgaaaccctatctctactaaaaatacaaaaattagccgggagtggtgatgggcacctgtaatccgagctctcctggaggctgaggcaggagaatcgcttgaacctgggaggtggagtttacagtgagctgagatcgtgccattgcactccagcctgggcgacaagagcgaaactctgtgtccaaaaaaaaaagaaaagaaaaaagaaaaaaagagtatctttaaatgaatggcaacccaatttgcaaatgtattttttttaatgttgccaattactttatgtgtttaaaaaatatctttctggtttactagggtattcttcaaaaaaagagaaaagattaaagctgcacagacatgatgatgtaaaagctagtagcttctcaagctgtgaaaggtctgtggtgcagagaatagctccctgtgagctgaattttgtttgctgtgggtgcagcatgggt

SEQ ID NO: 353501 - DNA, 484 bp, Homo sapiens
gtggcttatgcctgtaatcccagcactttgggaggcagaggcgggcagatcacctgaggtcaggagttcgagaccagcctggccaacatggtgaaaccctatctctactaaaaatacaaaaattagccgggagtggtgatgggcacctgtaatccgagctctcctggaggctgaggcaggagaatcgcttgaacctgggaggtggagtttacagtgagctgagatcgtgccattgcactccagcctgggcgacaagagcgaaactctgtgtccaaaaaaaaaagaaaagaaaaaagaaaaaaagagtatctttaaatgaatggcaacccaatttgcaaatgtattttttttaatgttgccaattactttatgtgtttaaaaaatatctttctggtttactagggtattcttcaaaaaaagagaaaagattaaagctgcacagacatgatgatgtaaaagctagtagcttctcaagctgtgaaag

SEQ ID NO: 353502 - DNA, 2624 bp, Homo sapiens
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgacgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggcccactgaacttacccaattccttctttcagtcttaagttttcccattctagacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 353503 - DNA, 2339 bp, Homo sapiens
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgacgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggaccccagcaccccactcctgaacctgaatgagcccctgggcctgggcccctcactgctctctccgtactcagacgaggacactacccagcccgggggccccttccagccaagggcaggctcagcccaggctgactgagccggctcctctccccatctgccttctcctcccccagaaaggacctcaaccacactccacgccggcagccaacgcacaggatgggggcgccaggagaggggcccctctctcctctatgtaccccctgcccacctcgggcctacctcagccctcacccctctgcctgctcccaatctgggggctctctggggtggtctcagctcagtgacctctgggaggtggtccctggccccctcctcctt

SEQ ID NO: 353504 - DNA, 2098 bp, Homo sapiens
agggctccggagcggcgactggcgagccatggcgctggggctgcagcgcgcaaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgacgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcgacagaatgggaccttgtc

SEQ ID NO: 353505 - DNA, 2172 bp, Homo sapiens
taaacaaatgaacaaaaaagagtgggagatgaaaataagtgtaacggggaaataatgcatgcaaggaaaaaggtttggagtagggggatttcagttttaaacagtatgatcagggtggtttcattgagaaggtgatagctgagcaaagacctggagtgtcccaggcagagagaacagcaagtgcaaaggcccttaggtggggactgtatctatcttttttggggtgtggggggacagggtgtgtcttgctctgttgcccaggctggagcacagtggtgcaatcacagctcactgcagccttgaactcctgggctcaagcgatcctcccatctcagtctcccaagtagctgggactacacttgtagctgggactacaagtgcgcttcattacgtctggctaattttttaatttctgtagagaaagaggtcttgctatgttgctcaggctggtctcaaactcctgggctcaagtgatcctcctgcctcagccttccaaagtgctgagattgtgcctggctgtctctgtcttctttggggaaaagcaaggccaatgtagctgaagcagagaggagagaaaggtgagggctgactgcatggagcctctgtggggcattgtgatggctttgaagtcaccttgcttgaggaggctgcctcagggcctttgcatatcctgatccttctgcctggcatacttttccctctgttctttgccatgttaccacatcctttagatctcaaaccaaatattactccttacacaaagccctgcctaacttcatacgctcatggtttataacactccataattacacaggcctttgtgtcataatttgatgactgtctgtcttctcctttgggtatgagaccttcaagggcaggggccagggctgtctgggtccctgctgttctcttctttgtgcacatgggtgggcggtggctaagcacagaggaagttctcagcacatatttgtgaatgaggagctaagattcacgcactcgcactgtgcctagctttgtgctaaatcctctatgcacctgatccaattggcgcttctcactggagtgtcggtcccataagggcagggagattcatccatcctggtcactgctgtgtctctagcacctggcacagtgcctgacacaaagtaggtgctcagtaaacatgttgggttttttgttgtttttgagataggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatgaagtatgtgtgagtatcctggtttcccaagtaacaacagctgacttaactgctttctcaccagtactagttatggttcaaaacaccttccatggatttactcatttattcctcacaacagaggagtaaatcaagagggaggtgctgttattagcccgtcttacagatgagggaactgaggcacagagagatgaagccacctgccccaggtcacacagcaagtaaatagcaatgcctggattcaaactagggcagcatctgactctggactcgggttcttcaccgcagccctgaacaccccagagaggttcagagagcagaacgtgcccaagacgtcactgccgtttgaatccagacaggcttgcctcaccacccaggcttttaactgccaggaaggggagacgggttggtgtgggatatgatgaggtttctcttcaaataacccgatcaatcttttattctttaattgatagtaccccccacctttttcccttcttctcctcttttcctttttgcctttgttaaatgcccagacacgccacaataccaggcgttatcaataccagctcacattcctttccttatttaaaaaaaggactaactttctaactcatcacagacaccccttcccctttcctctctgctttcttttacgtgtccaccttatct

SEQ ID NO: 353506 - DNA, 890 bp, Homo sapiens
  misc_feature (857)..(857): n is a, c, g, or t
  misc_feature (885)..(885): n is a, c, g, or t
  misc_feature (890)..(890): n is a, c, g, or t
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgacgcggtcagcaagagcatccacaccttgctggagcaaaggggccaaggcagttaacaaggggcanattatcgcctttccttgggcccgggaanttggn

SEQ ID NO: 353507 - DNA, 762 bp, Homo sapiens
  misc_feature (706)..(706): n is a, c, g, or t
  misc_feature (723)..(723): n is a, c, g, or t
  misc_feature (758)..(758): n is a, c, g, or t
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagggcttcgtcatggtgctcaccgccgagggagacatggcttacctgtcggagaatgtcagcaatcacctgggcctcagtcaagctggagctcattggacacagcatctttgatttcatncaccccttgtgaccaanaagagctttaaggacgcccttgaccccccaacttnaaca

SEQ ID NO: 353508 - DNA, 646 bp, Homo sapiens
cgaccaaaaggtgagaggactgcaagccggggcctgacccggaagagctgaaccgcagaaagggcattcaggacagttcaggtccccgggcaagtccagacattccttcggctcttgctcctttggcattgccctaggcagtcgtatgctcaggagaggaaagtctggagttcaggaaggatgtgggctggggatgtagcttgttgttttcccatctgctactgtgtgtgtggtttgtgtgtagtgtgtgcgtgttctgtgcatcattctgtgtgtgacattcttcattctgtgtggttttgtgtcctcacagcctctataggctccagctttctctgtggaagatgacagcaattatagcaggaccctgccaggctgtcgaaaagattccgcaataaaactttgccagtgggaagtacctagtgaaacggcctaagatgccacttcttctcatgtcccaggtgggggccctgccttgagccccagcttcactggtccctcttacccacagaggtgttgagcacgcccctgcctcctgcttcagcctcatccctcaccatttctctaaccctgatctctgctccagccaggccctcggtgggcccagcacatgccaagtttgtgccaatctctgtgcctttgccta

SEQ ID NO: 353509 - DNA, 2867 bp, Homo sapiens
tcagcttactgcagcctccgcgccctgggttcaagtgattctcctgcctcaacttcccaaatagccgggactacgggcatgtgccacattgcccggctaatttttgtatttttagtagagatggggtttcaccacgttgtccagtctggtctcgaactcctgacctcaagtgctccacctgcctcagccttccaaagtgctgggattacaggcgtgagccactgcacccggctagaactcactttctccaaatccctctgcttcgaatttcaccgtcttcagctctttctagttctgggcctcaccagcctctcattctgcctgttttcaaaccttacgatccccaaaaattgtctggttctgggcctctaactccctctggctctatagtctatgactaccagattcttttggttctagaattcactaacttcctctggttctagacctcttcctataaattaatccctcttgttttagatctcacaccctccaacgccctccggttccagatcttatattcagtgatttcctctggttctggaccccacaactccaagcttcctattggttccagttctcctgatcggtaatacatttggttccaaatccagacctcttaatctctctcttttttttttttttttttttgagacagagtcccactctgtcacccaggctggagtacagtggctcaatctcggctcactgcagcctccacctcctgggttcaagcaattcttgggcctcagcctcccaaatagctgggattacaggcatgtgccaccacgcccagctaagttttatatttttagtagagacagtgtttcaccatgttggccaggctggtcttgaactcccgacctcaactgatccacccgcctcagcctcccaaagtgctgaaattacaggagtgagcctggccagacttcttaatttctaaatcacttttgttttagaccttatgaggctcagcttattcttctgcagttctctataaccaagactcattttctctcatcaaaaacaagtacagagagtttgatgtgtttatctcttttttcttcctcttcttttttttttttttcttttttgagatggagtctctctctgttgcccaggctggagtataatggtgccatctaggctcactgcaacctccgcctcctgattcaagtgattctcctgcctcagcctcctaaattggtgggattacaggagcccaccaccacatccggctacctttgtgtattttttagtagagacggggttttgccaagttggaggggctggtcttgaactcttgacctcagatgatccacccgcctcagcctcccaaagtgctgggattacaggcataagccaccgtgcccgaccctgtccttatcttataataaccagttcttctagaaccagacgatgctctagttctcctagattctgaacctcatgacctgtaccactcactagttccagactacacaacttctagaaggtgccacctccagggtcctgattcaagatctggtgatctgctgtttctctggttctagaactgacttacaagtgccttctgattctagacctcattccgtaagttcccttggctctagacttcatcatttccagctcctcctcactcaagatctgactccaaattaccctgggtctagaattcagccttcaaatatcttctgattttagactttgccttatacatttctctggttttagatcttaccaccctcaactccttctgattctagatcttatggttcccaaatctctctggttctagaactcagattttaggcttttgtttttccttttttttgttaaaaaaaaaaaaatagagacggggtttcaccatgttgcccaggctggtcgcgaactactgagctcaagcaattctccctccttggcctcaccaaagtgctgggactacaggcatgagccactgagcccagccaggctttttctaattctatgctttattctataaattcctctgcttctaagcctcacagcttccaactgcctttgatttcagatccaaattcctctgattctataattcagcctccaaatgcttctgattctggaatctagacttttccctaaagattcctctggttctgaatcttataacctcaactccctaattccagaccccagcctcctaaatctattctgggcttcccaccccactgaacttacccaattccttctttcagtcttaagttttcccattctagacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 353510 - DNA, 2681 bp, Homo sapiens
tcagcttactgcagcctccgcgccctgggttcaagtgattctcctgcctcaacttcccaaatagccgggactacgggcatgtgccacattgcccggctaatttttgtatttttagtagagatggggtttcaccacgttgtccagtctggtctcgaactcctgacctcaagtgctccacctgcctcagccttccaaagtgctgggattacaggcgtgagccactgcacccggctagaactcactttctccaaatccctctgcttcgaatttcaccgtcttcagctctttctagttctgggcctcaccagcctctcattctgcctgttttcaaaccttacgatccccaaaaattgtctggttctgggcctctaactccctctggctctatagtctatgactaccagattcttttggttctagaattcactaacttcctctggttctagacctcttcctataaattaatccctcttgttttagatctcacaccctccaacgccctccggttccagatcttatattcagtgatttcctctggttctggaccccacaactccaagcttcctattggttccagttctcctgatcggtaatacatttggttccaaatccagacctcttaatctctctcttttttttttttttttttttgagacagagtcccactctgtcacccaggctggagtacagtggctcaatctcggctcactgcagcctccacctcctgggttcaagcaattcttgggcctcagcctcccaaatagctgggattacaggcatgtgccaccacgcccagctaagttttatatttttagtagagacagtgtttcaccatgttggccaggctggtcttgaactcccgacctcaactgatccacccgcctcagcctcccaaagtgctgaaattacaggagtgagcctggccagacttcttaatttctaaatcacttttgttttagaccttatgaggctcagcttattcttctgcagttctctataaccaagactcattttctctcatcaaaaacaagtacagagagtttgatgtgtttatctcttttttcttcctcttcttttttttttttttcttttttgagatggagtctctctctgttgcccaggctggagtataatggtgccatctaggctcactgcaacctccgcctcctgattcaagtgattctcctgcctcagcctcctaaattggtgggattacaggagcccaccaccacatccggctacctttgtgtattttttagtagagacggggttttgccaagttggaggggctggtcttgaactcttgacctcagatgatccacccgcctcagcctcccaaagtgctgggattacaggcataagccaccgtgcccgaccctgtccttatcttataataaccagttcttctagaaccagacgatgctctaacttcatcatttccagctcctcctcactcaagatctgactccaaattaccctgggtctagaattcagccttcaaatatcttctgattttagactttgccttatacatttctctggttttagatcttaccaccctcaactccttctgattctagatcttatggttcccaaatctctctggttctagaactcagattttaggcttttgtttttccttttttttgttaaaaaaaaaaaaatagagacggggtttcaccatgttgcccaggctggtcgcgaactactgagctcaagcaattctccctccttggcctcaccaaagtgctgggactacaggcatgagccactgagcccagccaggctttttctaattctatgctttattctataaattcctctgcttctaagcctcacagcttccaactgcctttgatttcagatccaaattcctctgattctataattcagcctccaaatgcttctgattctggaatctagacttttccctaaagattcctctggttctgaatcttataacctcaactccctaattccagaccccagcctcctaaatctattctgggcttcccaccccactgaacttacccaattccttctttcagtcttaagttttcccattctagacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 353511 - DNA, 1563 bp, Homo sapiens
gagccaaggaccctccctgactcccacctccctttctgccttgtaccccagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggcccactgaacttacccaattccttctttcagtcttaagttttcccattctagacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 353512 - DNA, 2283 bp, Homo sapiens
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgacgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcagatgaggaaactgaagctcagactgttgaccacaggcacagaactcagaagtgatggtgctgggacttcagccaaggtccacccaagtccaaggctcatcctcttacctccctcctgccctccgcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctggtgtgttgggggattaatgggattctctggccctcattacctagctggcttaaacctactgttttatagataggaaaccagagaggggcaggggctggttgagggtcatacagaaagtcagtgggccagctgagactaaagcctgatcttctagtttcactaatgggtattaaaaacctctgcagtgaactgagattgcgccactgcaccccagcatgagcgacagaatgggaccttgtc

SEQ ID NO: 353513 - DNA, 1066 bp, Homo sapiens
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacagctcttcttcccctctccaccccttctcttcccttgtattagttccctgttgctgctgtaatatattaccacgaactcagtggctccaaacaacacaaactcactgtcttaccgttctggaggtcagaaatttgaaatgaggccaggcattgtggctcacgcctataaacctagcactttgggaggccaaggcaggaggatggcttgagg

SEQ ID NO: 353514 - DNA, 311 bp, Homo sapiens
ccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggtgagccacagtaaaggggggacatcaaggcagcatcccctcaccccgtcttgcccctgcctcctgcttcagcctcatccctcaccatttctctaaccctgatctctgctccagccaggccctc

SEQ ID NO: 353515 - DNA, 502 bp, Homo sapiens
ggggcttgcacctgtaatcccagctactcggaaggctgaggcaggagaatcgcttgaacctgggaggcggaggttgcagtgagccgagatcgcgccactgcactccagcctgggcgacagagtgagaccttgtcttaaaaaaataaaatgctgtcagaataaaaagcagtcaacagaaatgaaacccttataggagacaaataaatgtgggcaattattttctgcaaaatgccctccaagcccctgggcgccattgccttctgtaataggacatcacctgaacaggctttctgggctggagccaaggaccctccctgactcccacctccctttctgccttgtaccccagccaggtggaagagaccggagtggtgctgtccctggagcaaacggagcaacactctcgcagacccattcagcggggcgccccctctcagaaggacacccctaaccctggggacagccttggtatggggcagggctggggccgggaggggttgtg

SEQ ID NO: 353516 - DNA, 2400 bp, Homo sapiens
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgacgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcagaccccagcaccccactcctgaacctgaatgagcccctgggttttcactttgtcacccagtctggagtgcagtggcacaaacacagctcaccgcagcctcgacctcctgggctcaagtgatcctcctacttcagctcccacaagtagctgggactgcagctatgtgccatcatgcctggctgatgtttatatgttttgtagagacgaggtttcaccatgttgcccaggctggtcttgaactcctgagttcaagcgatccacctgccttggcctcccaaagtgctgggattactggtatgaaccaccacgcccgacagtaaatatgttttgaatgaataaactctcataaatgaagtatgtgtgagtatcctggtttcccaagtaacaacagctgacttaactgctttctcaccagtactagttatggttcaaaacaccttccatggatttactcatttattcctcacaacagaggagtaaatcaagagggaggtgctgttattagcccgtcttacagatgagggaactgaggcacagagagatgaagccacctgccccaggtcacacagcaagtaaatagcaatgcctggattcaaactagggcagcatctgactctggactcgggttcttcaccgcagccctgaacaccccagagaggttcagagagcagaacgtgcccaagacgtcactgccgtttgaatccagacaggcttgcctcaccacccaggcttttaactgccaggaaggggagacgggttggtgtgggatatgatgaggtttctcttcaaataacccgatcaatcttttattctttaattgatagtaccccccacctttttcccttcttctcctcttttcctttttgcctttgttaaatgcccagacacgccacaataccaggcgttatcaataccagctcacattcctttccttatttaaaaaaaggactaactttctaactcatcacagacaccccttcccctttcctctctgctttcttttacgtgtccaccttatct

SEQ ID NO: 353517 - DNA, 326 bp, Homo sapiens
cactgcctccccacctcaacaccagctccctgctccccaagccccaaggaactgtctccttccttgccccctcatacccagtccccagatatttctctccccatttgcccccttggtggccctgatccctcccgatccccctcctcagtgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcaggtaagcaggaggaggggctggggtggctgt

SEQ ID NO: 353518 - DNA, 3413 bp, Homo sapiens
tcagcttactgcagcctccgcgccctgggttcaagtgattctcctgcctcaacttcccaaatagccgggactacgggcatgtgccacattgcccggctaatttttgtatttttagtagagatggggtttcaccacgttgtccagtctggtctcgaactcctgacctcaagtgctccacctgcctcagccttccaaagtgctgggattacaggcgtgagccactgcacccggctagaactcactttctccaaatccctctgcttcgaatttcaccgtcttcagctctttctagttctgggcctcaccagcctctcattctgcctgttttcaaaccttacgatccccaaaaattgtctggttctgggcctctaactccctctggctctatagtctatgactaccagattcttttggttctagaattcactaacttcctctggttctagacctcttcctataaattaatccctcttgttttagatctcacaccctccaacgccctccggttccagatcttatattcagtgatttcctctggttctggaccccacaactccaagcttcctattggttccagttctcctgatcggtaatacatttggttccaaatccagacctcttaatctctctcttttttttttttttttttttgagacagagtcccactctgtcacccaggctggagtacagtggctcaatctcggctcactgcagcctccacctcctgggttcaagcaattcttgggcctcagcctcccaaatagctgggattacaggcatgtgccaccacgcccagctaagttttatatttttagtagagacagtgtttcaccatgttggccaggctggtcttgaactcccgacctcaactgatccacccgcctcagcctcccaaagtgctgaaattacaggagtgagcctggccagacttcttaatttctaaatcacttttgttttagaccttatgaggctcagcttattcttctgcagttctctataaccaagactcattttctctcatcaaaaacaagtacagagagtttgatgtgtttatctcttttttcttcctcttcttttttttttttttcttttttgagatggagtctctctctgttgcccaggctggagtataatggtgccatctaggctcactgcaacctccgcctcctgattcaagtgattctcctgcctcagcctcctaaattggtgggattacaggagcccaccaccacatccggctacctttgtgtattttttagtagagacggggttttgccaagttggaggggctggtcttgaactcttgacctcagatgatccacccgcctcagcctcccaaagtgctgggattacaggcataagccaccgtgcccgaccctgtccttatcttataataaccagttcttctagaaccagacgatgctctagttctcctagattctgaacctcatgacctgtaccactcactagttccagactacacaacttctagaaggtgccacctccagggtcctgattcaagatctggtgatctgctgtttctctggttctagaactgacttacaagtgccttctgattctagacctcattccgtaagttcccttggctctagacttcatcatttccagctcctcctcactcaagatctgactccaaattaccctgggtctagaattcagccttcaaatatcttctgattttagactttgccttatacatttctctggttttagatcttaccaccctcaactccttctgattctagatcttatggttcccaaatctctctggttctagaactcagattttaggcttttgtttttccttttttttgttaaaaaaaaaaaaatagagacggggtttcaccatgttgcccaggctggtcgcgaactactgagctcaagcaattctccctccttggcctcaccaaagtgctgggactacaggcatgagccactgagcccagccaggctttttctaattctatgctttattctataaattcctctgcttctaagcctcacagcttccaactgcctttgatttcagatccaaattcctctgattctataattcagcctccaaatgcttctgattctggaatctagacttttccctaaagattcctctggttctgaatcttataacctcaactccctaattccagaccccagcctcctaaatctattctgggcttcccaccccactgaacttacccaattccttctttcagtcttaagttttcccattctagacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccagaaaaaagaagaacaaaacacatacaaacaaaaacaaaaaacacagagggggcgcgcgccgcgaccaaagatatatcccgcccgacgagggcccccaaacctcaaacgcgacaccaccaggctcttccgcacaacaaggggcgccccccaataagcgtgaccaccgacttctaacaacggcaaggaccctgcggcccgacgctattccaccacacctcgcgcaaaccgcggaacaacgcggcgacccgctggaaacaaccctcggaaaacagagaccctaacacccaggaggaggagtgacacaccatcatggcgcgcccaacccactcccccccacacagcgccttctcacaaggcccccacagagccgacacccctcagcaacaacatacacgcgacggatcacacgcgccggtccaaacaccgacgccgcgcccaatgcaccacagcgcgcaacgtgcacaaaacagctgaccgcaccaccgaaggaacacagcagccaccacgcaccaccaactttcacaccccggggaccccgacggcgccca

SEQ ID NO: 353519 - DNA, 2564 bp, Homo sapiens
cgccacagagaggagcgaggcgccagaggcaccatggactggcaagaccacaggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgacgcggtcagcaagagcatccacaccttgctgagcaagggccaggcagtaacagggcagtatcgcttcctggcccggagtggtggctacctgtggacccagacccaggccacagtggtgtcagggggacggggcccccagtcggagagtatcgtctgtgtccattttttaatcagccaggtggaagagaccggagtggtgctgtccctggagcaaacggagcaacactctcgcagacccattcagcggggcgccccctctcagaaggacacccctaaccctggggacagccttgacacccctggcccccggatccttgccttcctgcacccgccttccctgagcgaggctgccctggccgctgacccccgccgtttctgcagccctgacctccgtcgcctcctgggacccatcctggatggggcttcagtagcagccactcccagcaccccgctggccacacggcacccccaaagtcctctttcggctgatctcccagatgaactacctgtgggcaccgagaatgtgcacagactcttcacctccgggaaagacactgaggcagtggagacagatttagatatagctcaggatgctgatgctctggatttggagatgctggccccctacatctccatggatgatgacttccagctcaacgccagcgagcagctacccagggcctaccacagacctctgggggctgtcccccggccccgtgctcggagcttccatggcctgtcacctccagcccttgagccctccctgctaccccgctgggggagtgacccccggctgagctgctccagcccttccagaggggacccctcagcatcctctcccatggctggggctcggaagaggaccctggcccagagctcagaggacgaggacgagggagtggagctgctgggagtgagacctcccaaaaggtcccccagcccagaacacgaaaactttctgctctttcctctcagcctgagtttccttctgacaggaggaccagccccagggagcctgcaggcccactgaacttacccaattccttctttcagtcttaagttttcccattctagacccctaccctctaggctgtgctgctcctggacttcatgcctctccattctcattgcctacaatctctgtgccccagaaccccctccacttcccaccccagccctccagacatgcacttaccttgactttaccccacatgtttggggcacctggggctccctcaccccttgggtggtttgcaatctgaagacttctccagccacacaggcacatgcacaggcacggtgctgtctgcatattgccaggtggggagagaagccaggacccctcagctgtctgccaccatctatgtgcctcccttaccccccagctttctttctacagatggtgctactcttggtctcccacaggaaaaggcctccccccttcttagccccatttaccccgtttgtggaaggcactgctcgctctgttttgtcagagagtggcctatccagattggtgctatgggggggtctgacccctccctcctccctctggaggtgatgtgggccctcaatggagggaattgtgctgggctagggaaaggggagggactagactggccacactggctctgaaactcaccaatctctatacaccataaagacctcaccttggtaggcaccaga

SEQ ID NO: 353520 - DNA, 1040 bp, Homo sapiens
gtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggatgcggcccgcagccggcgcagccaggagaccgaggtgctgtaccagctggctcacacgctgcccttcgcccgcggcgtcagcgcccacctggacaaggcctctatcatgcgcctcaccatcagctacctgcgcatgcaccgcctctgcgccgcaggggagtggaaccaggtgggagcagggggagaaccactggatgcctgctacctgaaggccctggagggcttcgtcatggtgctcaccgccgagggagacatggcttacctgtcggagaatgtcagcaaacacctgggcctcagtcagctggagctcattggacacagcatctttgatttcatccacccctgtgaccaagaggagcttcaggacgccctgaccccccagcagaccctgtccaggaggaaggtggaggcccccacggagcggtgcttctccttgcgcatgaagagtacgctcaccagccgcgggcgcaccctcaacctcaaggcggccacctggaaggtgctgaactgctctggacatatgagggcctacaagccacctgcgcagacttctccagctgggagccctgactcagagcccccgctgcagtgcctggtgctcatctgcgaagccatcccccacccaggcagcctggagcccccactgggccgaggggccttcctcagccgccacagcctggacatgaagttcacctactgtgacgacaggattgcagaagtggctggctatagtcccgatgacctgatcggctgttccgcctacgagtacatccacgcgctggactccgacgcggtcagcaagagcatccacacctgtatgtatcccatttccccaggtgcgaagccagctgccacatggcccccagctgacaccaggaccccccagctccc

SEQ ID NO: 353521 - DNA, 1064 bp, Homo sapiens
gcacgaggctactgtcacatttcagtgatgtcacagctgcaggtggtacagagccagcaccaccatctgatgcccagcctgagtgctggctgaactgagaggaacagggttggtgcctggcactggtgttgctccattcatctctgaggtctcacagccccagcatgagtccatcagcaaagaagaggcccaagaacagcagggtttccaagatgcaagatgagaaactgcgggacgagacagagcagcctgtgagcaaagtaattgagcggaaccgtctgagaacggtgttaaaaaacttgtcgctcttgaagctactcaagagctcaaaccgccggatccaagaactgcataagctggccaaaaggtgttggcattcactgctcagtgttccaaagattctccgcatctcctctggggaaaacagtgcctgcaataaaacaaaacaaaataatgaagagttccaggagatcgggtgctccgagaaggaactcaagtccaagaaattagagtccacaggggaccctaagaaaaaagagtacaaggagtggaagtcccaggtgcagtcagggatgaggaacaaggagaaaacgtcattggcggcaatgccacggaaagaaaagcatatagagcctgaggttccaaggacatcgagggatgatagcttgaaccctggagtccaggggaggcaaccactcaccgagggcccccgagtcatcttcattaagccctaccgcaatagaactcccatggggcacatgaagcagctggatgtagccgaccagtggatctggtttgaggggctgcccacacgaatccacctcccggcgcccagggtgatgtgcagatcctccaccctgcgttgggtcaagcgccgctgcacccgcttctgctccgcatcacttgaaatgcctatgtggcatccatacaaggttgatgtgacctggacgagagccagaggtgcgagcagagggtggagatcgcgccatcagctgaaggggaggaatgggtggcgaaattcacgagtctacaaataagatcttccatatggcacctaagacgaa

SEQ ID NO: 353522 - DNA, 325 bp, Homo sapiens
tttttttttttggtagagtcagggtttcaccatgttggccaggcatctcaaactcctgacctcaaatgagccacccacctcggcctcccaaagtgctgggattacagacatgaggcaccacacctggctgattcctctgggtttatgtctctcttatcctctgtccctcagatgcaagatgagaaactgcgggacgagacagagcagcctgtgagcaaagtaattgagcggaaccgtctgagaacggtgagacgccctgttttggccccagcttggggaagctcatatactcatgcagtactgcccctggttgccaggctgagtg

SEQ ID NO: 353523 - DNA, 1856 bp, Homo sapiens
taccatgcctccgagacaagttcaaaccgtttcctcataagtcacatgacagtattaagaaagctaacattgattggtgcctgctaagtaccatcctacagtgttaagcacttaagaattttcccatttagtttattcttcacaacaatcctgttaggtagacagaattatcctagttttacagataaggaagctaaggctctgagaggttaaatatcttgcccaaatcacacaggtggtaagaggcagaagcagaatctgagcccgtttgtctgaatccaacacctgtgctctgtaagccactctgtttcactgccttctacttcacagaaatagtaaggatcccaagttgtaagggtcccgagtctggcatagagcgaggactcaatcagcgggagccattattatcatcacagtattgccattatctgcagcccaaggcctcatctctctccacgcccttggctaggatggtgttgccactgggggtttgcagggggcccagtctgttacagacaccctttgggaaagtctcagcatttaatatttctgtcaaggccacctttctgggctcctctttctgatttggcctctagtcgcaggcaatcaggaaacatagagctagaaggatcaggatcatctagccccatcattttccaacttaaaaattttttttttgtatggagacagagtctcaccatgttgcccaggctggtcttgaacagttttccaactttattaaagcagtgaaacctctgttcaaatatctatttccaagccccaattgtgttgttatgagctggggagaggtatcctgccccagtgggtcaggggaggtgacattgagacacctcctcagaaccctaaggttcttggagcacaatttagaaaaactactggactgttcaccctcccagctgaagtccagagagacagaaccctaatctagtggcagatgatgtagacaatattcattcttaggggccttaactactagtcatggctttcaccttcccaatctctcacatccctctgctagtgctcatcacacctcctcacaccagcacaaggcctctgggcagtagagaagtttctttgcaggcccctctagcctttcttaacaggctcccctgagctggctacatagcaactgtctcgggaaccagggcctcggtcctgctgtgctgactgcctttcctctccctgccagggaaaacagtgcctgcaataaaacaaaacaaaataatgaagagttccaggagatcgggtgctccgagaaggaactcaagtccaagaaattagagtccacaggggaccctaagaaaaaagagtacaaggagtggaagtcccaggtgcagtcagggatgaggaacaaggagaaaacgtcattggcggcaatgccacggaaagaaaagcatatagagcctgaggttccaaggacatcgagggatgatagcttgaaccctggagtccaggggaggcaaccactcaccgagggcccccgagtcatcttcattaagccctaccgcaatagaactcccatggggcacatgaagcagctggatgtagccgaccagtggatctggtttgaggggctgcccacacgaatccacctcccggcgcccagggtgatgtgcagatcctccaccctgcgttgggtcaagcgccgctgcacccgcttctgctccgcatcacttgaaatgcctatgtggcatccatacaaggttgatgtgacctggacgagagccagaggtgcgagcagagggtggagatcgcgccatcagctgaaggggaggaatgggtggcgaaattcacgagtctacaaataagatcttccatatggcacctaagacgaa

SEQ ID NO: 353524 - DNA, 2326 bp, Homo sapiens
taccatgcctccgagacaagttcaaaccgtttcctcataagtcacatgacagtattaagaaagctaacattgattggtgcctgctaagtaccatcctacagtgttaagcacttaagaattttcccatttagtttattcttcacaacaatcctgttaggtagacagaattatcctagttttacagataaggaagctaaggctctgagaggttaaatatcttgcccaaatcacacaggtggtaagaggcagaagcagaatctgagcccgtttgtctgaatccaacacctgtgctctgtaagccactctgtttcactgccttctacttcacagaaatagtaaggatcccaagttgtaagggtcccgagtctggcatagagcgaggactcaatcagcgggagccattattatcatcacagtattgccattatctgcagcccaaggcctcatctctctccacgcccttggctaggatggtgttgccactgggggtttgcagggggcccagtctgttacagacaccctttgggaaagtctcagcatttaatatttctgtcaaggccacctttctgggctcctctttctgatttggcctctagtcgcaggcaatcaggaaacatagagctagaaggatcaggatcatctagccccatcattttccaacttaaaaattttttttttgtatggagacagagtctcaccatgttgcccaggctggtcttgaacagttttccaactttattaaagcagtgaaacctctgttcaaatatctatttccaagccccaattgtgttgttatgagctggggagaggtatcctgccccagtgggtcaggggaggtgacattgagacacctcctcagaaccctaaggttcttggagcacaatttagaaaaactactggactgttcaccctcccagctgaagtccagagagacagaaccctaatctagtggcagatgatgtagacaatattcattcttaggggccttaactactagtcatggctttcaccttcccaatctctcacatccctctgctagtgctcatcacacctcctcacaccagcacaaggcctctgggcagtagagaagtttctttgcaggcccctctagcctttcttaacaggctcccctgagctggctacatagcaactgtctcgggaaccagggcctcggtcctgctgtgctgactgcctttcctctccctgccagggaaaacagtgcctgcaataaaacaaaacaaaataatgaagagttccaggagatcgggtgctccgagaaggaactcaagtccaagaaattagagtccacaggggaccctaagaaaaaagagtacaaggagtggaagtcccaggtgcagtcagggatgaggaacaaggagaaaacgtcattggcggcaatgccacggaaagaaaagcatatagagcctgaggttccaaggacatcgagggatgatagcttgaaccctggagtccaggggaggcaaccactcaccgagggcccccgagtcatcttcattaagccctaccgcaatagaactcccatggggcacatgaagcagctggatgtagccgaccagtggatctggtttgaggggctgcccacacgaatccacctcccggcgcccagggtgatgtgcagatcctccaccctgcgttgggtcaagcgccgctgcacccgcttctgctccgcatcacttgaaatgcctatgtggcatccatacaaggtgggtgtgacaacaacactgccaggctaggtgagatgcaagccccaagccaggcccagagctgggccccagagtcagggttcaggatctggagtcttgagtggtgtgtggctggtagtgctgggaggctccgccttcatgtccagagagggggaagccttagaccaacatcatacagaagggtagtgactaggttgaggcgtctcaggatacagctaggagatgtgtggaaggaggggcactgaagtgagccatctcactgcctgaaggccttagcagaggtggaaactgctgtggctctgaatctcacagtcagaggcctacataagtgggtttaaggatttccaaatgtgggaggggggagatggtcaagtagggctttgctgcatcccattccctctaagatcaattcaactctctatttatgtttgattgattcatgcctcaaataagatttactctgaacaggctaggcatggtggctcacgcctgtaatcccagcaccttgggaggtcgaggcaggaagactgcttgaggccaggagttcaagaccatcctgggcaacataatgagacactgtctctacaaaaaatttaaaaatt

SEQ ID NO: 353525 - DNA, 2272 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaatt

SEQ ID NO: 353526 - DNA, 2561 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaattttcttcaagtgtttggggttatttgtttatgtattagagaattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgca

SEQ ID NO: 353527 - DNA, 3912 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaaagacgggttttcaccatgttgcccaggctggtctcagactcctgagctcaagccatccgcctgcctcgacctcccaaagtggtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaattttcttcaagtgtttggggttatttgtttatgtattagagaattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgcagttttcaagagccatatgtaatttgctcacaattgatttttaaaaattgatttgggagttgctttgtaataatcttctgcttctaatcttcctttgcaagtcagactttaaagaagactttataaagctttcttttttaaaggaagtaacctacttttttctttatcaagaatatttctgaggttgatacatgactttaacattttattatttattgtaaaatcaatttagcataatttattttattagggagaatgtgtacccatcttccagcttcagcacatttttaaggattgtttttaagcttagtaattgtggtattaaatgacttagaactaatggagaaaaacctgataggaaattgatagaaaaacgaatgaaatatttttcatacataatttcagttggaggtaatggaaaatatgtagtctctcagttatttgtgggtaaatatgttttgctgttgatacagtaataattatggagtgttttcaaagccatgatataatttttaaaaatagatttttaaggaaggctcatcttgatctcattcgtttatttcagcttaatttatatattctttcctattgaggcttaaattttgttaagcaatgtgaggattattgtggtaagttgtatttagtaatcaatacagtgtgatactggcactaggattgacaaataaagcaatggaacagaagagagagcctgaaaacagatcaacgtttatatgatcacttgatttcgacaaaggtggcaaaacaattcaacagagaaggaaagtcttttcaacaaatggagccagaatagaatagctgaatatccatatagaaaaaagtgaacaatgaccccctacctcacaaaaatgactttgagatgaatcatagacctaaatgtaatattttaaaagtatgaagctttttaactgaaaacagatgatatttttgtgacttggggggttagccaaaggtttcttaggtcacagaaagcagtaaccataaaagatccaaaattagagctcatcagaattgtcattgaaagtgttaacaaaagtaatatcaaatgacatttgaaaaatatccttgtaaaatgactatattaataggtataaggatttttcttattaatctaataaaattccttaataggaatttccatagcttaagagtggtttattttatctgcatcttctttggtgattgcaaatcccttgtgatacttcatgattacttctgtctgtgaataaagaagtgtgacttgtctgggtgct

SEQ ID NO: 353528 - DNA, 2068 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataaaaagtgattctccctcggcatggctataatgaacttggttagaacctataaatgtttttgttatgtgagactttttaaccgatgaattcgttgaatacacaccacatttaaaaactgcctaggaggtaatccaaaaatatatagttataaaacttcttgtattatgtaccaaatctctttcttaaaatataaaataaaattatctagtttaagattacatt

SEQ ID NO: 353529 - DNA, 3787 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaaaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaattttcttcaagtgtttggggttatttgtttatgtattagagaattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgcagttttcaagagccatatgtaatttgctcacaattgatttttaaaaattgatttgggagttgctttgtaataatcttctgcttctaatcttcctttgcaagtcagactttaaagaagactttataaagctttcttttttaaaggaagtaacctacttttttctttatcaagaatatttctgaggttgatacatgactttaacattttattatttattgtaaaatcaatttagcataatttattttattagggagaatgtgtacccatcttccagcttcagcacatttttaaggattgtttttaagcttagtaattgtggtattaaatgacttagaactaatggagaaaaacctgataggaaattgatagaaaaacgaatgaaatatttttcatacataatttcagttggaggtaatggaaaatatgtagtctctcagttatttgtgggtaaatatgttttgctgttgatacagtaataattatggagtgttttcaaagccatgatataatttttaaaaatagatttttaaggaaggctcatcttgatctcattcgtttatttcagcttaatttatatattctttcctattgaggcttaaattttgttaagcaatgtgaggattattgtggtaagttgtatttagtaatcaatacagtgtgatactggcactaggattgacaaataaagcaatggaacagaagagagagcctgaaaacagatcaacgtttatatgatcacttgatttcgacaaaggtggcaaaacaattcaacagagaaggaaagtcttttcaacaaatggagccagaatagaatagctgaatatccatatagaaaaaagtgaacaatgaccccctacctcacaaaaatgactttgagatgaatcatagacctaaatgtaatattttaaaagtatgaagctttttaactgaaaacagatgatatttttgtgacttggggggttagccaaaggtttcttaggtcacagaaagcagtaaccataaaagatccaaaattagagctcatcagaattgtcattgaaagtgttaacaaaagtaatatcaaatgacatttgaaaaatatccttgtaaaatgactatattaataggtataaggatttttcttattaatctaataaaattccttaataggaatttccatagcttaagagtggtttattttatctgcatcttctttggtgattgcaaatcccttgtgatacttcatgattacttctgtctgtgaataaagaagtgtgacttgtctgggtgct

SEQ ID NO: 353530 - DNA, 2347 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaatt

SEQ ID NO: 353531 - DNA, 2626 bp, Homo sapiens
caggtctttttctcttctgccgtttttataaaacaaaaaataacttcggtgcaacgtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaattttcttcaagtgtttggggttatttgtttatgtattagagaattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgcagttttcaagagccatatgtaatttgctcacaattgatttttaaaaattgatttgggagttgctttgtaataatcttctgcttctaatcttcctttgcaagtcagactttaaagaagactttataaagctttcttttttaaaggaagtaacctacttttttctttatcaagaatatttctgaggttgatacatgactttaacattttattatttattgtaaaatcaatttagcataatttattttattagggagaatgtgtacccatcttccagcttcagcacatttttaaggattgtttttaagcttagtaattgtggtattaaatgacttagaactaatggagaaaaacctgataggaaattgatagaaaaacgaatgaaatatttttcatacataatttcagttggaggtaatggaaaatatgtagtctctcagttatttgtgggtaaatatgttttgctgttgatacagtaataattatggagtgttttcaaagccatgatataatttttaaaaatagatttttaaggaaggctcatcttgatctcattcgtttatttcagcttaatttatatattctttcctattgaggcttaaattttgttaagcaatgtgaggattattgtggtaagttgtatttagtaatcaatacagtgtgatactggcactaggattgacaaataaagcaatggaacagaagagagagcctgaaaacagatcaacgtttatatgatcacttgatttcgacaaaggtggcaaaacaattcaacagagaaggaaagtcttttcaacaaatggagccagaatagaatagctgaatatccatatagaaaaaagtgaacaatgaccccctacctcacaaaaatgactttgagatgaatcatagacctaaatgtaatattttaaaagtatgaagctttttaactgaaaacagatgatatttttgtgacttggggggttagccaaaggtttcttaggtcacagaaagcagtaaccataaaagatccaaaattagagctcatcagaattgtcattgaaagtgttaacaaaagtaatatcaaatgacatttgaaaaatatccttgtaaaatgactatattaataggtataaggatttttcttattaatctaataaaattccttaataggaatttccatagcttaagagtggtttattttatctgcatcttctttggtgattgcaaatcccttgtgatacttcatgattacttctgtctgtgaataaagaagtgtgacttgtctgggtgct

SEQ ID NO: 353532 - DNA, 2059 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtaaatgctcagctaatctcattggcataatattctgttttttaagtattttttaaacttgtattttattgttattttagcagtgtgcattgaacatctacttttttttttctttttaatttttcgtagagacgggttttcaccatgttgcccaggctggtctcagactcctgagctcaagccatccgcctgcctcgacctcccaaagtggtaggattacaggcgtgagccactgtgcccagccaaacatctacttttgattgggttaatgcatttaagaagtctatttcagaaaatctctaaatttcatgtagtagtatgtcatcttgtctttagagaagttaaacatgcagatttccattaagttagataattttttattttcttttttttattttttgagacagagtctcactgggtcgcccaggctggagtgcagtggcacaatctcggctcactgcaacctctgcctcccgagttcaagcgattctcgtgtctcagcttcccgagtagctgggattatgggcacatgccaccacacccggctaatttttgtattttcagtagaggtggggtttcaccatgttctccaggcttgtctcaaactcctgacctcaagtgatctgcccaccttggcctcccgaagtgctgggattacaggcatgagccactgcacccggctaggtattttgtactgttggataattgacagttattttgtaga

SEQ ID NO: 353533 - DNA, 755 bp, Homo sapiens
gtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggttcggttcccgggaacgagtcctgcccctcttcttttgccccgcctccgccccagaggggcgaggatcccggatgttgcctcctcggcgctgtgaatcaccgccctttcttctcaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggc

SEQ ID NO: 353534 - DNA, 3831 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaattttcttcaagtgtttggggttatttgtttatgtattagagaattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgcagttttcaagagccatatgtaatttgctcacaattgatttttaaaaattgatttgggagttgctttgtaataatcttctgcttctaatcttcctttgcaagtcagactttaaagaagactttataaagctttcttttttaaaggaagtaacctacttttttctttatcaagaatatttctgaggttgatacatgactttaacattttattatttattgtaaaatcaatttagcataatttattttattagggagaatgtgtacccatcttccagcttcagcacatttttaaggattgtttttaagcttagtaattgtggtattaaatgacttagaactaatggagaaaaacctgataggaaattgatagaaaaacgaatgaaatatttttcatacataatttcagttggaggtaatggaaaatatgtagtctctcagttatttgtgggtaaatatgttttgctgttgatacagtaataattatggagtgttttcaaagccatgatataatttttaaaaatagatttttaaggaaggctcatcttgatctcattcgtttatttcagcttaatttatatattctttcctattgaggcttaaattttgttaagcaatgtgaggattattgtggtaagttgtatttagtaatcaatacagtgtgatactggcactaggattgacaaataaagcaatggaacagaagagagagcctgaaaacagatcaacgtttatatgatcacttgatttcgacaaaggtggcaaaacaattcaacagagaaggaaagtcttttcaacaaatggagccagaatagaatagctgaatatccatatagaaaaaagtgaacaatgaccccctacctcacaaaaatgactttgagatgaatcatagacctaaatgtaatattttaaaagtatgaagctttttaactgaaaacagatgatatttttgtgacttggggggttagccaaaggtttcttaggtcacagaaagcagtaaccataaaagatccaaaattagagctcatcagaattgtcattgaaagtgttaacaaaagtaatatcaaatgacatttgaaaaatatccttgtaaaatgactatattaataggtataaggatttttcttattaatctaataaaattccttaataggaatttccatagcttaagagtggtttattttatctgcatcttctttggtgattgcaaatcccttgtgatacttcatgattacttctgtctgtgaataaagaagtgtgacttgtctgggtgct

SEQ ID NO: 353535 - DNA, 3603 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaaggcaaaagaaaaacagaacgcaaagaaagctcaggaaaccaaatgaagatgttttcagatatgtacacatttctgcttctgcacatattttcatggaaaccattatgtataaagaacttagagcaacatcctaattggctcagtgcacgtttggcaatagtgccagcctgtcttgtctttaatgcatggattcataaacttcttccctacctgcatcatgtgcatgtagtgcatattaaatgaaagtgatattaagaatgctttcccaaattccattatttgacattgagtctgacaactgttagttttctggttgtctaactaccatatgaagctagaaaatgcacaaacgatattccttatctgtaatttaaatacttaaaatttgcaattgtcagatcttgattaaactggttgtcttatttcttctcatcattaacggaaaaaaaatcagtatttctatctttgatatctaagtgttttgaggattttaaaactgaattttatctgctataccagttatttgagaaagtatgattttaatgtaaatcatttaaaaaggacaaaagtataatttccagtgattttcactgctgtcagtagaaaagtaataaacatctcaattttattttagtaaattttcttcaagtgtttggggttatttgtttatgtattagagaattgtttcaggaaggtctgagtattatgcttcaaagcaaaatttcaggttaagaagaaattgtaaatcttaaagaatgttggtgttactctcaatggaatattgtttcaagcttgtaagctgtgtataaaaaaactggaggtctgacagttcatgttatctgcttttttaaaaagatggtagtggtgatgggggtctttctatgccaatttgaataaatttcgtacagcctgcagttttcaagagccatatgtaatttgctcacaattgatttttaaaaattgatttgggagttgctttgtaataatcttctgcttctaatcttcctttgcaagtcagactttaaagaagactttataaagctttcttttttaaaggaagtaacctacttttttctttatcaagaatatttctgaggttgatacatgactttaacattttattatttattgtaaaatcaatttagcataatttattttattagggagaatgtgtacccatcttccagcttcagcacatttttaaggattgtttttaagcttagtaattgtggtattaaatgacttagaactaatggagaaaaacctgataggaaattgatagaaaaacgaatgaaatatttttcatacataatttcagttggaggtaatggaaaatatgtagtctctcagttatttgtgggtaaatatgttttgctgttgatacagtaataattatggagtgttttcaaagccatgatataatttttaaaaatagatttttaaggaaggctcatcttgatctcattcgtttatttcagcttaatttatatattctttcctattgaggcttaaattttgttaagcaatgtgaggattattgtggtaagttgtatttagtaatcaatacagtgtgatactggcactaggattgacaaataaagcaatggaacagaagagagagcctgaaaacagatcaacgtttatatgatcacttgatttcgacaaaggtggcaaaacaattcaacagagaaggaaagtcttttcaacaaatggagccagaatagaatagctgaatatccatatagaaaaaagtgaacaatgaccccctacctcacaaaaatgactttgagatgaatcatagacctaaatgtaatattttaaaagtatgaagctttttaactgaaaacagatgatatttttgtgacttggggggttagccaaaggtttcttaggtcacagaaagcagtaaccataaaagatccaaaattagagctcatcagaattgtcattgaaagtgttaacaaaagtaatatcaaatgacatttgaaaaatatccttgtaaaatgactatattaataggtataaggatttttcttattaatctaataaaattccttaataggaatttccatagcttaagagtggtttattttatctgcatcttctttggtgattgcaaatcccttgtgatacttcatgattacttctgtctgtgaataaagaagtgtgacttgtctgggtgct

SEQ ID NO: 353536 - DNA, 1863 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataaaaagtgattctccctc

SEQ ID NO: 353537 - DNA, 1938 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtaattaataatgcttgtgctactcaagccatagtgagtgtgttactgaactgtacccaccaggatgtccatttaggcgagacattatcagagtttaaagaattttcacaaagttttgatgcagctatgaaaggcttggcactgagcaattcagatgtgattcgacaagtacacaacagtttcgccagacagcaaatgtttgaatttgatacgaagacatcagcaaaagaagaagatgcttttcactttgtcagttatgttcctgttaatgggagactgtatgaattagatggattaagagaaggaccgattgatttaggtgcatgcaatcaagatgattggatcagtgcagtaaggcctgtcatagaaaaaaggatacaaaagtacagtgaaggtgaaattcgatttaatttaatggccattgtgtctgacagaaaaatgatatatgagcagaagatagcagagttacaaagacaacttgcagaggaacccatggatacagatcaaggtaatagtatgttaagtgctattcagtcagaagttgccaaaaatcagatgcttattgaagaagaagtacagaaattaaaaagatacaagattgagaatatcagaaggaagcataattatctgcctttcattatggaattgttaaagactttagcagaacaccagcagttaataccactagtagaaaagtttgagaaacactttgagaagacactactaggcaaataaaattttggaccattaacttaaagacgagaatacatgggaaaataggataaaagaacaaggtgtgagaaggaatagaaggaaacaaacaggaaagatatggctgcaccatgcagtgctactatatgctgagattctacaggatgagatttttgaatagctgaggcagttgcctataatctgtgatgacataaaagtatttgacctaaaatctttttatttgcaaaataataaataaaaagtgattctccctc

SEQ ID NO: 353538 - DNA, 1389 bp, Homo sapiens
agcaggccctctcgacgtcggcctgtggggagcgatgccgacaagcaggagcggtcccggcttcggaaagggcccaccctgaggaatggtccggccgggcctagcgaggatgtccctaccgcgatgctggttccgttacccagggtggacaggcgcggaagcgggacggggaagagcgatagtttcgcggcgtttgcccagcctcaacccctgggatgcgggtgagagacatggaggactggtcagaatttgcgcgtccctggggccgcacaaaaggctcccagccggcctcccgcaatgtcctcacctgtacctggcagccgaccccctggatccgcagcgccgccaggagaagtcctgcgcagcgctgggaaacgacaaaagaaggcagcctgacgggcagcgacagccacagcaacagcaacagccccactgccgccggggattccaggccccagcccttccgaatccgctacgggtgctgcaaggcctgggaagagtttcgatgtctctagggtggctagagcgtcctcccgcgctcagtcgcgctgcaggtgacggcgcccggaggctgtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctgagaattttgaaaaattaaagccagttcatgggttaatttttcttttcaagtggcagccaggagaagaaccagcaggctctgtggttcaggactcccgacttgacacgatattttttgctaagcaggtatggtccttggatactctgaaaagtctcaagagcaaccctttttataaacaagactctagtttactactgtttgctactagtgtagtagtcctcaaactcttacactcttaaaaattattgacatctccaattacagtcttaaaaattattgacatctcaaaagagcttttgtttctgggattatctatcaatgtttgccatattagacattaaaactgaaacattttaataatatttacgccaggcatggtggcttataactgtaatcccagcactttgggaggccgaggcaggaggatcccttgagcccaggaatttgttttttctttttctgagatagagtcttgctctgtcgcccaggccagagtgcaatggtgcgaggctgaggtgggaacactgcatgagcccaggatatggaggctgagtgagatatg

SEQ ID NO: 353539 - DNA, 379 bp, Homo sapiens
ttgtatagccatgccggctaggctatagagcagcaaaggtctacagaggagcaaagggtaacatcccactctcttccccagtcttgcaggcacaaacgcagttggcatagccttgaggctgatttttccagatgaaccaggaagacccttggtttttggcagatttaataaccaacattcaaacaaggcactttaaaaaatctacaattcgagaggatttcctggcactatataaaaccccttccatcaatgggagttgttctcccttcttgaattggagtgttcattaagtccataaaatggaaagcacatgtaggataataacacagatattttgtgttagagaaaagttatgaagcatggcatcgaaagaggttag

SEQ ID NO: 353540 - DNA, 518 bp, Homo sapiens
gtgctggctctgtttccagttggaagatatagcagacacactgacatttgctgatcctccagctgcagagtgaaatccctgaggccttaggtgtcttcttactctcccagaatccaagtttaatgctaggataaatgttattaattacctgactaattcttcaaacagcttcttgtccaatggggaaaaaacaatcagatacattgcattgtgacaaatgccatgagagcaccaagctcagagggaaatatacatgtattcatatgtgtttatatatatgtaagtatatatgtatacctagacatgtatttatagatgtacgagagagaaaataaagcattaggagtggccttgataacaaagtgattgaacccctcctgggcgcaagaaatcctcccacctcagcctcccaagtagctggggctatatgcatgcaccaccacacccagctaattttttattttttgtagagacaagatctcactatgttgcccaggctggtatcaaactcctgtgct

SEQ ID NO: 353541 - DNA, 4762 bp, Homo sapiens
tttcatttttttgtttagtatttttgagaacccagccacctggccatgctgtaccagccttgtgctgagtgctggggataaaggaacaaataaaacccagtccaggcttctgtgtgcccagccctgtgccgggtcccagtgggtaacagcatgtccaatcccctcagtgtcccactagaggcttcctttggggctgctggggacatcttgtttctagttgagaattcagatttatgtccaaagacaagaactccctgaggggcagattacaacatggactgggccattacaatcaacaaggacacaaagctaacacagccatcgttatacaccagacatgtgctaaggacttgatttccccattgtttaatcatcaccaactccattatcacccccatttcacagatgtggaaactgaggctgagaagagtaagggacttgtccaagggcacagagcaagtcagggctacggtgatgtttcaggcccagacctgtttgcctctggagcccagggtttaacacaccccagtgctgctgtgaaagggctctggacagctcaggctggccggccaatgcggggataaccgaacagaggtatggaacagaaaggggcgttgaggatgttgctgtgtgtgtgcggtggggggagtgacaaggcttcagcaatggtactcattctctccaaccagctcccagtgctgctgtcctctgatccaccctccgctctgcctgccatggactaattgttctgaaatcccatggatcaagtcactcctcagctgaggacctgtccatggctccctggtacccagaggatagaaacccagcattcaaaacctctctaaccagctccccacctcaaccctcacactcctgctcactagcccccaggcgcagtgggctcttccagcggccaagcctgtgcctacggtgccttcttgcctggaatgcccaactcccccttctcagccttctttgactctcaagtaggaaaagcactctttgtctccctgagccccttggcacttatcacagagcactctgggcgttaacttccactgtctccgtcttggattagagtggatctcagagggcccggtggtgtctgcttcacctccctctccactgcagcagcttagcaaggactggccgggtaaactaaaaaatgcaaagagctgagagaatcctgggaaagtgcacatttcccaggactgcccaatgacaagccccgtaccaaggcacagcatcaggataccctgatgtggaagaaccaaaaattgcaccctcatggcttatcaggatggtccttgtgtctgtccctttcaagggttctgataatgaaatctgggcaagtcaccctcctgctttaaaacttccaatggttcccagaggtctagcataaaatccaaactcaagggcccacataacctaggtgctgcctggcccccaggccctcctcttgccacgcccccctccctggccagcctccctcacttctttcagttcctcaaggactccccctcactaaagccttacccaggtcgcctctctgcctagggggctcctccattccctgctcactcagccacctccctctccctcttcaggtctcactttttaggggaggcttccctgatctgtccagataagacctcaccactcccacccaatcccaaacgctcccataacctgatcgtttccttcacagcaagaattaatcttcagtgtaaataatgatctactgaagacctatgaggaatgggaaagtcttgttttttgctgattcttcaacacccagctcagagcctaaatatctctcaaatgaatgaatatatgaatgaatgagtgaatgaacctatatacataaatcaagacaagaaggtgggcagaatcctagggaacactgaggcaggaaaagcagggccctgggccaggcgtcatggctcacacctgtaatcccagcactttgggaggccaaggcaggcagatcacttgaggtcaggactttgagaccagcctggccaacatggtaaaaccctgtctctactaaaaacacaaacattagccgggtatggtggcacatgcctgtagtcccagctactcaagaggctgaggcaggagaatcacttgtacctgggaggaggaggttgcagtgagctgagatcgtgccactgcactccagcctgggcaccacagcaagactccgtctaaaaaaaaaaaagaaaaagaaagaaagaaagaaaaagaaaaccagggccctaactaaaaaagacaggaggaaaaacagggccctaactaaaaagagaggaggggccctaactgaaaaaaccagggccctaactaaaaaagtcaggaggaaaaacagggccctaactaaaaagagaagaggaaataaaccagacagtgcagcctcccagaagcaaaaggagggagtttctggaactgcactagagactggcacatggagtcctgaggaaagagcactggattggacatcgaggaggtcactggggcctccctgattgaaccaaggttccgtggaggtgggcacagggctggtacattgcagggggcagaggagtaaagagggatgaataagcaaagctctcaggcgacggttgctcagctgggtctatgccagcctggccctgcagggtctgcggaagacagggcccctgtgtcatagtcaccaaaagcatcaacagagcataacattctttttgttgacagattacattgaggcaacttggcttttggagttatcagggctcagtctcaaaggcagatgcatcagagccaagacccggccctcaagtcctcctattagggcagcactagggctacctctttgtcagcagaacctttggatagccgctgatggggtgagtcagctttctgggcccggcagaccttttgggaatccctggcttttggggcacaacatcctggggaccaccaaaaagccctttcacctgagctttgggaaagaggaacagctccggctgtgggtggctcatgtcaccatctggaagccagctgggccacagcagacgcgtaagtcctgtattcattcatccccttctccttttggcagaaaagggatggcgtgggttggaggggtgttttcctgggttcttgcacaattgctcattagaaattcacttctgtttgggtgttggaagctgggcgattccccctagtagtgatccttcctgtctcactggtcacaaagccctttggcatctacaagctcgttgggtccacacagcagctttgttaggtgggtagggggagaccaaggcacccatcctacaggtggagaaaccgaggctgaagctgggaggtgagccagtctcctggcttccagcccaggactctgcactcctccccccacctccccacctacttcagcaggtcacctgtgaatctgatagtcaggtgggccccaccctgccagctggccccagcgggcatgactcatccgcttccccatgactcacacacctcaggtgctcctcctctggtcaacaagtccagagacttggcaaatggacccccatttttctcacctctccaaagcctctgggaagaattcctgcacctcctctttatggggactctgctcttctacagaatagcaaccaaggccttgagagggaaagcaactctcctaaagtcacatagcaagcaaccagcacagccagggtgggagccaggcatccgggcaccgagcccagtcccggcctcctccctacaagatcactctcgcctgacctccctctcaaggacaggaaaggagcagagacgcactctgagccttattaggaagacctcagggactcccactgaatccactgtggctacagcggctgcttccaccactgaagtcccctccaggcttccctgggcagccagggcggggtttaagaggacgacaggtgtctgtattgctctacctacctaacaaggctgtgcagggtgaagagtgctgctccgtgggaaggcgctgggaccaaggccgaagcactggacaaagagagctatgagcactacctgtaaacaaagggcacagaatgtcagcctcagggggagttcaaggtcatctggtcaaatccccatttgatgtttcaacccctttcctcccctccaccaggggtcacacaatcagtacttgcacacatccagcaacaccgcactcactacctgccaaggctgcaagacctgctgctggagggtttggctgcgtaaaagaattgtcctaaggatgcactaaaatctctctcttcttatgccttgtacctgctggtattagctctgcctccttttgggtcagccagaacaggtctgtccccctctttcctgatggctctttagagatttgaagacagtgatcctgggcccctcaagtcttctacaaattgtgcaccccctttcctccagctcttcctgagaccagggtttccggttcgctcaccctgttccctgatctgctccagatgaaacctgtccctactgacagcacaagacccagaattagacaatcagtcaagctctatccaggacagggcaagcaggactctcacctccttcattagagatatcatgcttctattaattgagcctaaaatcccatttgcatttaaggcagccctattgcatggctgaattcagtttacagtcaacttcagagctgtacgttagtactctgaagttatataaactgggccctcacttaactgtgtaacttgagcaagcaaaaaaa

SEQ ID NO: 353542 - DNA, 423 bp, Homo sapiens
caccccctcatcccacacagtcagaaatccatgtgtaactttcagctctcccagaacttcactgctagtagtctactgttgacctgaagccttactgataacataaatagttcatgaacacattttatatgttttatgtacagtatactgtattcttacaataaagtaagctaaagaaaagaaaatgttaagaaaatcataaggaagagaaattatatttactattcattaggttgaagtgaatcatcataaaggtcttcatcctcaggggtcaactgtatatcagagatgcattgagttggttgtggtttttggttctgttttttttagtataaattctaagttgtttggtttcatatattacaggtttactttgttgcaagagtttttgttgtctttgaaataaattttatgtacatacgt

SEQ ID NO: 353543 - DNA, 418 bp, Homo sapiens
gatgtcaagaggcaggtgacagcacagctccaggagggtgggcggacaggcccagggtctgccttggacttgctctcccagtgggtggattctagaggcaagtggtgtgaccctgtgcagggaggcatttccactggggagaggctgggatggcccacggtgcagggtcagtggaaatcacacatgcagggcgtcctctctggcactgactgaggcccggtcagcccccacacaatgcccttggacccctcagcacctgtcaccaggcctggtcttcatggtgcatgtctacggaagggtcccggtggcacacagacacctcaacgtggaccggtgctggacagaggacagtgtcactctaaactccgcgggcacagatgtggcgccagcggtgggagtgtggagggccagggcggcc

SEQ ID NO: 353544 - DNA, 419 bp, Homo sapiens
tccaggcgcttcttctcgacatcaggctgcttcttccctctgctggctgagttctggggtctttatgggcacaggatggggacggggcaggccgtaggtagttttggaaaaggcaatattcaattggtaaaaagacagtattcagaaataaccaatcgggagagaatggaagttctcactttgggctgtgggtttcaggcttttcggcttgaaggtgggattttgccagcgacccgcccctgtatgcctacagtttctctgcctcctgttgctatcaattttaagctaccaacatgacgccactgaacagaatcgggaagagacatgcggaacacatattatatagtatttccaccaacagatataatagatgtaaataacctcaaaagagtagataatagtaaaataattatgaagtg

SEQ ID NO: 353545 - DNA, 467 bp, Homo sapiens
tttttttaataaggacccaatcattgaatttaggggtaccctaatccagtggccctcatcttaattaattatatcttccaagataatttttccaaataagaccacattctgaggttccgggtggacatgttcttagggagaaaaacattcaacctagtagcagaaggtcatgtgtttcaaatcagcacatggatctaacagttaatgtagtgtctatgataaatggagagcacttaataaagcattgattcagacaaaatacatcaacaataagcatcattctccttccactttctgcataaaaacattatttttaatacaatatggtttgatagaaacatttaatcttgttccaaaatattttcagggatccagtctctggagaaaactgatgtttaagatacagctacacatatgtattaagtaattacaaaacaacaaaaattaaaagcattttctttaatgcc

SEQ ID NO: 353546 - DNA, 1740 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaaggagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353547 - DNA, 1202 bp, Homo sapiens
cactttgggaggccgaggtgggtggatcacctgaagtcaagagttcgagaccagcctggccaacatgggaaaccccgtctctactaaaatacacaaattagccaagcgtggtggcaggcacctgcaatcccagctacttgggaggctgaggcacagagaattgcttgaacctgggaggcagagattgcagtgagccaagatcgcgtcattgcactccagcccaggcacactagagcgaaaccccatctcaaaaaaaaaaaaattatttctgtgatctcgtactccagccttcctttccccacccactcttaactccttgaaaggatcttatatacaggaggctctcaaagcactgggtaatgactgttctcaatgtatgtgtctcattttgtagggcgtgactaacttaagcagcttcttccttgcttggttgggctttgcaaatttttgctactttatttcctgtaccctgaacccttggtgggtcagaggtcagaagggttccctcccactgtcttcagacattgtcaatagcaaattgcacctctttgattcctctccttttctctcctttctacagagtcgggcgctgctgtctgtgaattctttttgaaagctgcctgcggcaaaggtaagaaactccgggctccctgatgtgcctccggaggcgccctcccacctccttctccccggcagacttggaggccgccaggtctctggcttacattgctttctacagactaacgatctctgtagataaaactggtttggacaggctaggaccctgatggggtgttccacctgaaacctaaacgcaggactgaacctggctctaaggctgccttatcacttcgcattccccgtggccacaagctgacctgtgacatggagagaagcccccagcattgagacactcaggaactttctcaatgtcacagagttaataagcggcagagcccagtgtctgaacccaggtctttctcattccatagtttccactggctcatggttttctgtggcctcccatcgaaacaccccatgataacccatcttgcggggtcttgttctcgataaccagccctcaacacagactacacaaaactactgaggtgcgagaatcccttgaaccagggagtcagaggttgcagtgagccgagatcgtgccattgcactccagcctggcaacagagcaagactctatc

SEQ ID NO: 353548 - DNA, 481 bp, Homo sapiens
tatttttcgtttttgtgtgtctgcatggtgtttttcgggcagtggcttctgccatcatcaccacatgtttctctgctgcccactgtcctgaggtgggccgtcgtggaagccctgcttcctgccgtttgcgggacgagtcccgccctcttttttcctgtccccatcggtagtctgcgtgcacgtgttttccacagtaaaaccgtgttgtgtaactctcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaaggtgagtccctgggctgggggacagggtggggtcttcccttaccgtcagtggccattccctcatgccccatgtgtttggtgaaatgagaaaaatg

SEQ ID NO: 353549 - DNA, 300 bp, Homo sapiens
tttttttcttttcttttcttttttattaacaagcaacataatcggccgggcgttgtggctcacacctgtaatcccagcactttgggaggccatgagtaactattaaaatgtaaaatgtctgtcagtgtagtacctcaaatcatgttgccttctgtgagggggacctctgcccctttccaggacgtgatgccttcaggtggctccaggagttaggaagtgaaggtacctcagcttcttcaggccgtgtcccccaggctcagggtggcctctctgctgacaccctgtccctatcttgccggc

SEQ ID NO: 353550 - DNA, 1817 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353551 - DNA, 1744 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcacaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353552 - DNA, 2085 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagaagagacaggatttcaccgtgacagccaggatggtctccgtgccagccaggatggtctcgatctcctgaccttgtgatccgcccacctcggccttccaaagtgctgggattaccagcgtgatccactgcgcccggccatgagtaactattaaaatgtaaaatgtctgtcagtgtagtacctcaaatcatgttgccttctgtgagggggacctctgcccctttccaggacgtgatgccttcaggtggctccaggagttaggaagtgaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353553 - DNA, 1329 bp, Homo sapiens
tatttttcgtttttgtgtgtctgcatggtgtttttcgggcagtggcttctgccatcatcaccacatgtttctctgctgcccactgtcctgaggtgggccgtcgtggaagccctgcttcctgccgtttgcgggacgagtcccgccctcttttttcctgtccccatcggtagtctgcgtgcacgtgttttccacagtaaaaccgtgttgtgtaactctcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353554 - DNA, 1206 bp, Homo sapiens
cctcgggcggcggcggcggcggcggcgaggcgaagcgaaggaggagtgtgtgcggcggggccggcggcgggtaaaggcgagaaggctgcaggacaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353555 - DNA, 1690 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcacaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353556 - DNA, 1823 bp, Homo sapiens
atagagctggcaagagtgttgggtgccaactgggcagagcccctcagggcagcagggactcaggggtgggtgtcagtacagagtcagtgcccccagctgcctcctgacccttttgttcagtgcttgaggctgccgttttaggagtcatagagtaaagagaagctatggaagggcctggataatcaggactgggatgaggcagggtcagggctggatttgtcatgtggctctgcaggctccccttacccaagtctaagcatcgtcccatctctctgatcctgtaatcaaaacctgtccccaaggtagcttaggtgtgtcacagccacgagggaaaacgttgggtacagcccaccctctgtccccagcagtggctccccaagggaggggaggctgggacacttctgatgctgttccctcccatctcctgccagggaaccccagaccttggctcagaggtaagtgactggcctgtggtgcagaagggcttggtccccagacggggtggcggagctcaggtgccacgggcttctctttgtcctgctacccacttgggagtccctccctgggcaggccatgtgtccaggtgggagagttgtgggcctgaaagagcaggtcgctagcaggtcgccttctggcggccttgttctcccttgcatctgcggagttgctggctagtttctgcaccactgcactttccatcctgagctccctcaccctctaatttgaaagaaactctgtaccactgagaatttcagagtcatgtcccgactggggacttggtggatgatttgggatttggtgggcactcccttagttgaaaactgcatttgaacagtgttgttgtctgtctctcctcttcccccacttcctgctgttcccagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353557 - DNA, 1129 bp, Homo sapiens
cctcgggcggcggcggcggcggcggcgaggcgaagcgaaggaggagtgtgtgcggcggggccggcggcgggtaaaggcgagaaggctgcaggagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353558 - DNA, 2247 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaaggagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaagagacggcggcgcggccggcgacgccgaccatccctctaccgcgagcgcggacgcacaaagagccacgaccagccacaacgagtagaagaaaagaagggcgagcagcatgtagaagagaggaagtagcagacaacacaagagcgagacgaggcgtcttatactatataaaccaaatatggggctgaaaggagaagaggaaaagaaattgcataacaagagcgaagtatttattcgtgtacaaaagagaagaatctattcttgacggaggcgtggagtgaccataaaggaggggagcaaacacacacaaagaagagtatatgaagtatcgacgttggagaaattataaaaaaaacagaatgggagaaa

SEQ ID NO: 353559 - DNA, 374 bp, Homo sapiens
gaagacagttgtgtgcaaacactggctgcgtggcctatgcaagaaaggggaccagtgtgagttcctgcatgagtatgacatgaccaagatgcccgagtgctacttctactccaagttcggtaaggcgcctggagccctggaggctctgctgagaaccagggtgcagaggggtccgctggctgctcagtgcccacactgtctctgcctgcttttcccatctttctattctcagaggagaactctggcagaacctgccagcctcagccagcttttaggggacagtgtggctattttctgctcatctctttttttttttttttttttttaaagacatagggtctcgctatgtttcacatactggtcttgaactcctg

SEQ ID NO: 353560 - DNA, 1719 bp, Homo sapiens
tcgctcgctcctccttcgcttcgcctcgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353561 - DNA, 1763 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353562 - DNA, 2012 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagaagagacaggatttcaccgtgacagccaggatggtctccgtgccagccaggatggtctcgatctcctgaccttgtgatccgcccacctcggccttccaaagtgctgggattaccagcgtgatccactgcgcccggccatgagtaactattaaaatgtaaaatgtctgtcagtgtagtacctcaaatcatgttgccttctgtgagggggacctctgcccctttccaggacgtgatgccttcaggtggctccaggagttaggaagtgaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcacaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353563 - DNA, 1734 bp, Homo sapiens
gagacctcctcttctggatcccgggacgctccccttggtttcaggactcctgactcccaggcccccatttccaccgtctggggactccttttaccctcactcggactcaggagttcactgcctcggatctttggccctctgcggctgttcaaagagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353564 - DNA, 1146 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagccgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353565 - DNA, 1646 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacgccctcgatttgaactgcccatgggaaccaccgagcagcccccactgccgcagcagacacagcctccagcaaaggagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactcccctcatccagggagggaggcagctgctggggaggggcttggctaggtagttctgtgtggcggtggtcattcccctcattaaacaccagttcttggtgacgccaggggctggtaggtcattcaaagctgtggccagctcacgcctgcttcctccctccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353566 - DNA, 1583 bp, Homo sapiens
cctcgggcggcggcggcggcggcggcgaggcgaagcgaaggaggagtgtgtgcggcggggccggcggcgggtaaaggcgagaaggctgcaggagaccgagggggagccgggccggtggggccgccgccgccgccatgcaggaaatcatcgccagcgtggaccacatcaagtttgacttggagatcgcggtggagcagcagctgggggcgcagccgctgcccttccccggcatggacaagtcgggcgctgctgtctgtgaattctttttgaaagctgcctgcggcaaagggggcatgtgtccgtttcgccacatcagtggtgagaagacagttgtgtgcaaacactggctgcgtggcctatgcaagaaaggggaccagtgtgagttcctgcatgagtatgacatgaccaagatgcccgagtgctacttctactccaagttcggggagtgcagcaacaaggaatgtcccttcctgcacatcgaccccgagtccaagatcaaggactgtccttggtatgaccgtggcttctgcaagcacggtcccctctgcaggcaccggcacacacggagagtcatctgtgtgaattacctcgtgggattctgcccggaggggccctcgtgtaaattcatgcaccctcgatttgaactgcccatgggaaccaccgagcagcccccactgccgcagcagacacagcctccagcaaaggagaaccccgcaggtcatcggggtcatgcagagtcaaaacagcagcgcgggcaaccggggaccccggccactggagcaggtcacctgttacaagtgtggcgagaaaggacactacgccaacagatgcaccaaagggcacttggcctttctcagtggacagtgacagcagctggagccagctccgagcagcccgggggccccgctgttgggagtgtgcatttaactgtttcatgcgcttgttggcgcgactgtggctcgagctggcccgcagacacgtgggtttcatcactctgaggggccacgtctgttagtttcctatcattttgccttagtattttttgaaaaagggacatgtgtcctgtgggtccctgcagtcgacatcatgtttggctgggcatcgatgcctcctttctgggactcccggcacaactccctgccctgctgaatcctaaagctgtgcctatatctgtgatttgaatgagggagccctttggggcaaattcaggtgcccccattgcctcaggctggccctggtcccaggtggcagcggttgaggaggggtacagggctctcaagcctgaggttttcttctctgggcttaattttctcttggggtacgtgcctgacagtgtttaaggtgtccgttgaactggagttgcagacttttaaatagatgaccccttcagatcatctgtgcctacctcctgcccatcaggcgtctacactgtcactcagacacctgtggcatgtggaggagactgccctgtcctgagcctggaaaatgtgaaactgtctcctgcaacctgctgggcatgtgggcctggctgtgttcaattgcaagaacaatttttatgaaatggattaaagcttgttttttaa

SEQ ID NO: 353567 - DNA, 312 bp, Homo sapiens
gaaattgagaagctaattctagaatttatttggaaatgcaaagaacctagattacctaaaacaactttgaaaacgaatatagctagaggactaaaactgcctcacttcaagttatagtaaaacagtgtggtacaggcataaagataaggtaaacatatcaatggaacagagtccagaaacagacccacagatatataaacaactgatttttgacaaaggtacaaggacaatccggtagaggaatgatagtcctttcaacaactggtactaaaacagctggatattcatatgcaaaaaactgaacttggatcc

SEQ ID NO: 353568 - DNA, 300 bp, Homo sapiens
tctattccttattcatggtttactttcagcccagatacttgcatagcataccatactcatgcatatgttcttcaaccttgtcttccagggtgtgcccatgcagatactgacctcacttagggccaaacacctgggaagagcagacttcagagtaggggatgggagatgtagatgagtcaaaaagtatttcatttcctgtaatcccagcactttgggaggctgaggtagatggatcacttgaaaccaggagtttgagaccagcctggccaacattgtgaaaccccgtctctactataaata

SEQ ID NO: 353569 - DNA, 1096 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctggcggctttggtgtcatcaaatgtgagaagccctggactttacacatcccgagccagtgtgatccagtatgattgggagtccgagtgccagatgccggtcaggacctgttatgctgggtctcagaatgcggaaactctccctgtccgaggtggaacagtttgtccttgagtgaggactggagtcctgagtgactcttttgatttgatcctgtttccctcaaacctgagatgggagcctcactgtattgcccaggctggtcttgaactccggagctcaagtgatcgtcttgcttcagccttgcaaaatgatggtgaagctgcatcattgtctgggatggagtccctgtctgaccgggccatgttgtatgttccttgctgtacacgtggttgacaaagaaaagggaagatggagctgcgatgttggacatgcctggcccccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcac

SEQ ID NO: 353570 - DNA, 1384 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctggcggctttggtgtcatcaaatgtgagaagccctggactttacacatcccgagccagtgtgatccagtatgattgggagtccgagtgccagatgccggtcaggacctgttatgctgggtctcagaatgcggaaactctccctgtccgaggtggaacagtttgtccttgagtgaggactggagtcctgagtgactcttttgatttgatcctgtttccctcaaacctgagatgggagcctcactgtattgcccaggctggtcttgaactccggagctcaagtgatcgtcttgcttcagccttgcaaaatgatggtgaagctgcatcattgtctggggtaaatacctgaggttcgttgtctcacgccaagggaatcaaggacgtggacacacaagaagtgagtttaagagcggaggtttaataggcgaaagagaaaagagaatagctctagctcctgcagagagaaaagggctcccaagtaggacttccagtccgtggcgaagggcacggggtttatagactggcttcaggaggtggtgtctgatttacgtaggccccaaagattggttggaccaggtgtgccaatcagaagctggctgccccaccctaatcttttattatgcagatggagtccctgtctgaccgggccatgttgtatgttccttgctgtacacgtggttgacaaagaaaagggaagatggagctgcgatgttggacatgcctggcccccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcac

SEQ ID NO: 353571 - DNA, 1240 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctggcggctttggtgtcatcaaatgtgagaagccctggactttacacatcccgagccagtgtgatccagtatgattgggagtccgagtgccagatgccggtcaggacctgttatgctgggtctcagaatgcggaaactctccctgtccgaggtggaacagtttgtccttgagtgaggactggagtcctgagtgactcttttgatttgatcctgtttccctcaaacctgagatgggagcctcactgtattgcccaggctggtcttgaactccggagctcaagtgatcgtcttgcttcagccttgcaaaatgatggtgaagctgcatcattgtctggggtaaatacctgaggttcgttgtctcacgccaagggaatcaaggacgtggacacacaagaatggagtccctgtctgaccgggccatgttgtatgttccttgctgtacacgtggttgacaaagaaaagggaagatggagctgcgatgttggacatgcctggcccccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcacccacagctgtcttggtaagttcttttacctctgtgccaccagcccaaacagttgctgctcacatcctaccgggcccctctccagc

SEQ ID NO: 353572 - DNA, 1093 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctggcggctttggtgtcatcaaatgtgagaagccctggactttacacatcccgagccagtgtgatccagtatgattgggagtccgagtgccagatgccggtcaggacctgttatgctgggtctcagaatgcggaaactctccctgtccgaggtggaacagtttgtccttgagtgaggactggagtcctgagtgactcttttgatttgatcctgtttccctcaaacctgagatgggagcctcactgtattgcccaggctggtcttgaactccggagctcaagtgatcgtcttgcttcagccttgcaaaatgatggtgaagctgcatcattgtctggggtaaatacctgaggttcgttgtctcacgccaagggaatcaaggacgtggacacacaagaaaaagggaagatggagctgcgatgttggacatgcctggcccccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcac

SEQ ID NO: 353573 - DNA, 1159 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctgagatgggagcctcactgtattgcccaggctggtcttgaactccggagctcaagtgatcgtcttgcttcagccttgcaaaatgatggtgaagctgcatcattgtctggggtaaatacctgaggttcgttgtctcacgccaagggaatcaaggacgtggacacacaagaagtgagtttaagagcggaggtttaataggcgaaagagaaaagagaatagctctagctcctgcagagagaaaagggctcccaagtaggacttccagtccgtggcgaagggcacggggtttatagactggcttcaggaggtggtgtctgatttacgtaggccccaaagattggttggaccaggtgtgccaatcagaagctggctgccccaccctaatcttttattatgcagatggagtccctgtctgaccgggccatgttgtatgttccttgctgtacacgtggttgacaaagaaaagggaagatggagctgcgatgttggacatgcctggcccccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcac

SEQ ID NO: 353574 - DNA, 311 bp, Homo sapiens
aaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcacccacagctgtcttggtaagttcttttacctctgtgccaccagcccaaacagttgctgctcacctgaaacaaagaataaatgtggtttttaagc

SEQ ID NO: 353575 - DNA, 282 bp, Homo sapiens
tacctcagcctcccaagtagctgagaacacaggtgcgtaccaccacaccagctaatttttcttttctttttttttttctgtagagatgggagcctcactgtattgcccaggctggtcttgaactccggagctcaagtgatcgtcttgcttcagccttgcaaaatgatggtgaagctgcatcattgtctggggtaaatacctgaggttcgttgtctcacgccaagggaatcaaggacgtggacacacaagaagtgagtttaagagcggaggtttaataggcga

SEQ ID NO: 353576 - DNA, 1155 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctggcggctttggtgtcatcaaatgtgagaagccctggactttacacatcccgagccagtgtgatccagtatgattgggagtccgagtgccagatgccggtcaggacctgttatgctgggtctcagaatgcggaaactctccctgtccgaggtggaacagtttgtccttgagtgaggactggagtcctgagtgactcttttgatttgatcctgtttccctcaaacctgagatgggagcctcactgtattgcccaggctggtcttgaactccggagctcaagtgatcgtcttgcttcagccttgcaaaatgatggtgaagctgcatcattgtctggggtaaatacctgaggttcgttgtctcacgccaagggaatcaaggacgtggacacacaagaatggagtccctgtctgaccgggccatgttgtatgttccttgctgtacacgtggttgacaaagaaaagggaagatggagctgcgatgttggacatgcctggcccccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcac

SEQ ID NO: 353577 - DNA, 1751 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctggcggctttggtgtcatcaaatgtgagaagccctggactttacacatcccgagccagtgtgatccagtatgattgggagtccgagtgccagatgccggtcaggacctgttatgctgggtctcagaatgcggaaactctccctgtccgaggtggaacagtttgtccttgagtgaggactggagtcctgagtgactcttttgatttgatcctgtttccctcaaacctgagatgggagcctcactgtattgcccaggctggtcttgaactccggagctcaagtgatcgtcttgcttcagccttgcaaaatgatggtgaagctgcatcattgtctggggtaaatacctgaggttcgttgtctcacgccaagggaatcaaggacgtggacacacaagaatggagtccctgtctgaccgggccatgttgtatgttccttgctgtacacgtggttgacaaagaaaagggaagatggagctgcgatgttggacatgcctggcccccaggtagctttttcctattggcacagctgctggcattcacccgtgcaaacttccagcttgcttatctatgtctgcagcttgatttttcaggctgctgtttgttagaaaagaaatgacttgggggctgcttttcattaaaaggaaaaccttaccggggatttccttaccctcactatctgcctaaataatttcttgtttaactcctatgtcacttgggattacaggcatgagccgctgtgcctgctagagggttttttatctttattcctcaagattttgcatttagataattatgttaaacttgggtgtgctaggtagacatacgtctgctgattacctgtttaggaagaatgtggattcgtacgtagggaaaaggagtcaggctggtgggaccaggggaaagcaaagagataaagcaaataagctatagatctgcattttcttcatggtccaggatatataaacaaaaaaaggaagcagataagctataggcttgcttttctttatgacccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcacccacagctgtcttggtaagttcttttacctctgtgccaccagcccaaacagttgctgctcacatcctaccgggcccctctccagc

SEQ ID NO: 353578 - DNA, 1257 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctggtaactaattttaaacattacatctatggtgagttaaatgtgggttatgaaggagaacgcaaaataaaaacgttataaagatgtaaaggagttttatggggcggcatctcttgggcaaatatcagaccgccgtaggtagtcgttaattctctcgtttttaggcggctttggtgtcatcaaatgtgagaagccctggactttacacatcccgagccagtgtgatccagtatgattgggagtccgagtgccagatgccggtcaggacctgttatgctgggtctcagaatgcggaaactctccctgtccgaggtggaacagtttgtccttgagtgaggactggagtcctgagtgactcttttgatttgatcctgtttccctcaaacctgagatgggagcctcactgtattgcccaggctggtcttgaactccggagctcaagtgatcgtcttgcttcagccttgcaaaatgatggtgaagctgcatcattgtctgggatggagtccctgtctgaccgggccatgttgtatgttccttgctgtacacgtggttgacaaagaaaagggaagatggagctgcgatgttggacatgcctggcccccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcac

SEQ ID NO: 353579 - DNA, 1850 bp, Homo sapiens
gggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagttttaccagaaggtttcgaaggaaccttaaagtttggaagcgtaagagtttatctggtaactaattttaaacattacatctatggtgagttaaatgtgggttatgaaggagaacgcaaaataaaaacgttataaagatgtaaaggagttttatggggcggcatctcttgggcaaatatcagaccgccgtaggtagtcgttaattctctcgtttttaggcggctttggtgtcatcaaatgtgagaagccctggactttacacatcccgagccagtgtgatccagtatgattgggagtccgagtgccagatgccggtcaggacctgttatgctgggtctcagaatgcggaaactctccctgtccgaggtggaacagtttgtccttgagtgaggactggagtcctgagtgactcttttgatttgatcctgtttccctcaaacctgagatgggagcctcactgtattgcccaggctggtcttgaactccggagctcaagtgatcgtcttgcttcagccttgcaaaatgatggtgaagctgcatcattgtctggggtaaatacctgaggttcgttgtctcacgccaagggaatcaaggacgtggacacacaagaaaaagggaagatggagctgcgatgttggacatgcctggcccccaggtagctttttcctattggcacagctgctggcattcacccgtgcaaacttccagcttgcttatctatgtctgcagcttgatttttcaggctgctgtttgttagaaaagaaatgacttgggggctgcttttcattaaaaggaaaaccttaccggggatttccttaccctcactatctgcctaaataatttcttgtttaactcctatgtcacttgggattacaggcatgagccgctgtgcctgctagagggttttttatctttattcctcaagattttgcatttagataattatgttaaacttgggtgtgctaggtagacatacgtctgctgattacctgtttaggaagaatgtggattcgtacgtagggaaaaggagtcaggctggtgggaccaggggaaagcaaagagataaagcaaataagctatagatctgcattttcttcatggtccaggatatataaacaaaaaaaggaagcagataagctataggcttgcttttctttatgacccaggacatacagccctgccgagcaaataatgaacgtaactcacaaacttcctgcttatcatcaaacgcacgcatccacttatcatcaaacacctcgggtgacagaagaatgcaggtcagctccctgctgccttggcattatcaatcagcccaggaaccatcctataaaatctccagcaagcctttgtttccttgcagtcagctcctcttccactgattctgcctgttgctccctgataacatactttgatactgtctttaataaatctgcctttcttcacccacagctgtcttggtaagttcttttacctctgtgccaccagcccaaacagttgctgctcacatcctaccgggcccctctccagc

SEQ ID NO: 353580 - DNA, 1059 bp, Homo sapiens
gtaacagaaagatatctagataatccccatatattagaaattaaatgcatttttaaatagcccatagtcaaaaagtcgtcagggaaattagaaaacatcttgaatagaatggaaacaaacagacaacatgtcaaaagatatgatccagccaaagcgctattgaggaaattaaagcagttagtgatttaaaaatctcagatctcccatataaacttccacattaagaaaatagaaaaagaagagcaaattataatgaaagtaatcagaaggaaggaaatagacaaaagcacaactatgaagaagcagaaaattaaaatagaaaacattaaaagaaagctggttctttgagaagatcaataaatttaatgaactttagccagactaatcaggaaaagagaagacacattacaaattgcagaattgaggaagaagggacatcactactgatcctacagatgctaaaaaatagataatagaatattaacgattttatgccagtaaacttttaagtttaatggacagatttcttgaaagctcactcaacaaaaaataggcaacctggccaggcgtggtagctcacatctgtaatcccagcacttttgggaggccgaagcaggtggatcacctgaggtcagcagttcaagaccagcctggccaacatggtgaaaccccagctctactaaaaaaaatacaaaaattagccgggcgtggtggtatgcacttgtagtcccagctactcaggaagctgaggcaggaagaccacttgaatctgggaggtgtgagtttgcagtgagatcaccccactgcactccagcctgggtgacagagtgagactctgtctcaaaaaaaaaaaaaaacctgagtaatctcatctctattcaaaaaaacctgagtaatcttatctctattcaaagaaattgaatttgtggttcaaacttttttcacaaaacttaagatctaggtctattccgtggtaaattcatccaaacatttaagggagaagtaatgtaaattctgtgcaaattcttccgggaaataggagagaacatattccacctc

SEQ ID NO: 353581 - DNA, 9110 bp, Homo sapiens
  misc_feature (3667)..(3667): n is a, c, g, or t
  misc_feature (5720)..(5720): n is a, c, g, or t
  misc_feature (6098)..(6098): n is a, c, g, or t
cggggccagggcagcgcggactcgcgtcccgcggagcgttccaggcgggcgcgcggctttctccccagacccaccgagtggcggcggaggcgagatgcgcgggggcgtgctcctggtcttgctgctgtgtgtcgccgcgcagtgccggcagagaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagagaacgccatccaatatcacatgccatagatggcaccaataactggtggcaaagtcccagcattcagaatgggagagaatatcactgggtcacaatcactctggacttaagacaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttcgaacgcattagaacgctcaatgcagatctcatgacccttagccaccgggaacctaaagaactggatcctatgttaccaagacgctattattattcaataaaggacatttctgttggaggcatgtgtatctgctatggccatgctagtagctgcccatgggatgaaactacaaagaaactgcagtgtcaatgtgagcataatacttgcggggagagctgtaacaggtgctgtcctgggtaccatcagcagccctggaggccgggaaccgtgtcctccggcaatacatgtgaagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtgtctccttatgaggatgagccttgccgcccctgtaattgtgaccctgtggggtccctcagttctgtctgtattaaggatgacctccattctgacttagagaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctcttggtcaggtaaacagtatgtccgggtggctggtcaccgacttgatcagtcccaggaagatcccgtctcagcaagatgcactaggcgggcgccatcaggtcagcatcaacaacaccgcggtcatgcagagactggctcccaagtactactgggcagcccccgaggcctaccttggaaataagctgactgcgtttggcggattcctgaaatacacggtgtcctacgatattccggtagagacggtagacagtaacctcatgtcgcatgctgacgtcatcattaagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccacctacaattctgcaaaaatggctctttacaggttggagtccgtctctctggacatagccagctctaatgccatcgacctggtggtggctgctgatgtggagcactgtgaatgtccgcaaggctacacagggacctcctgtgagtcgtgcctctctggctattaccgcgtggatggaatactctttggaggaatttgtcaaccctgtgaatgccacggccatgcagctgagtgtaatgttcacggcgtttgcattgcgtgtgcgcacaacaccaccggcgtccactgtgagcagtgcttgcccggcttctacggggagccttcccgagggacacctggggactgccagccctgcgcctgccctctcaccatagcctccaacaatttcagccccacctgccacctcaatgatggagatgaagtggtctgtgactggtgtgccccgggctactcaggagcttggtgtgagagatgcgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgcgctgacgggttctatggggacgctgtgacagccaagaactgccgcgcctgtgaatgccatgtgaaaggctcccattctgccgtgtgccatcttgagaccgggctctgtgactgcaaaccaaacgtgactggacagcagtgtgaccagtgcttgcatggctattatgggctggactcaggccatggctgccggccctgcaactgcagcgtggcaggctccgtgtcagatggctgcacggatgaaggccagtgtcactgtgtcccaggtgtggcagggaaaaggtgtgacaggtgtgcccatggcttctacgcctaccaggatggtagctgtacaccctgtgactgcccacacactcagaatacctgcgacccagaaactggagagtgtgtctgcccccctcacacacagggtgtgaagtgtgaagaatgtgaggatgggcactggggctacgatgcggaggtggggtgccaggcctgcaattgcagtctcgtggggtcgactcatcatcggtgcgatgtggtcaccggccattgccagtgcaagtcaaaatttggtggccgggcctgcgtacagtgttccttgggttacagagactttcccgactgtgttccctgtgactgtgacctgagggggacgtcgggggacgcctgcaacctggagcagggtctctgcggctgtgtggaggaaaccggggcctgcccttgcaaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaacgctgggctccgatcagcctcttctgcgtgtggtttctcagagtaacttgaggggcacgacngagggggtttactaccaggcccccgacttcctgctggatgccgccaccgtccggcagcacatccgtgcagagccgttttactggcggctgccgcagcagttccaaggagaccagctcatggcctatggtggcaaactgaagtacagcgtggccttctattctttggatggcgtcggcacctccaattttgagcctcaagttctcatcaaaggtggtcggatcagaaagcaagtcatttacatggatgcaccagccccagagaatggagtgagacaggaacaagaagtagcaatgagagagaatttttggaaatattttaactctgtttctgaaaaacctgtcacgcgagaggattttatgtctgtcctcagcgatattgagtacatcctcatcaaggcatcgtatggtcaaggattacagcagagcagaatctcagacatttcaatggaggttggcagaaaggctgaaaagctgcacccagaagaagaggttgcatctcttttagagaattgtgtctgtcctcctggcactgtgggattctcatgtcaggactgcgcccctgggtaccacagagggaagctcccagcagggagtgacaggggaccacgccctctggttgctccttgtgttccctgcagttgcaacaaccacagtgacacctgtgaccccaacaccgggaagtgtctgaactgtggcgataacacagcaggtgaccattgtgatgtgtgtacttctggctactacgggaaggtgactggctcagcaagtgactgtgctctgtgtgcctgtcctcacagccctcctgccagttttagtcccacttgtgtcttggaaggggaccacgatttccgttgtgacgcctgtctcctgggctatgaaggaaaacactgtgaaaggtgctcctcaagctattatgggaaccctcaaacaccaggtggcagttgccagaagtgtgactgcaacccgcacggctctgtccacggtgactgtgaccgcacatctgggcagtgcgtttgcaggctgggggcctcggggctccggtgcgatgagtgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccgtagccattgagaggctgcagatgagcatcacagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaaggctgctgaagatttattgtcacaaattcaggaaaattaccagaagccgctggaagaattggaggtattgaaagaagcagcaagccatgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctgcatgttcaagaagaacaaaatctgacctcagagctcattgtccaaggaagaggattgatagatgctgctgctgcacaaacagatgctgtacaagatgctctagagcacttagaggatcaccaggataagctacttttatggtctgccaaaatcaggcaccacatagatgacctggtcatgcacatgtcccaaaggaacgcagtcgacctggtctacagagctgaggaccatgccnctgagttccagagactagcagatgttctgtacagtggccttgaaaacatcagaaatgtgtccctgaatgccaccagtgcagcctatgtccattacaacatccagagcctgattgaagaatcggaggaactggccagagatgctcacaggactgtgactgagacgagcctgctctcagaatcccttgtttctaacgggaaagcggccgtgcagcgcagctccagatttctaaaagaaggcaacaacctcagcaggaagcttccaggtattgcattggaactgagtgaattgagaaataagacaaacagatttcaagagaatgctgttgaaattaccaggcaaaccaatgaatcactcttgatacttagagcaattcctnaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccactctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctattaaagtcgccgtgtctgcagacagagattgcatccgggcctaccagcctcagatttcctctaccaactacaataccttaacactaaatgttaagacacaggaacccgataatcttctcttctacctcggtagcagcaccgcttctgatttccttgcagtggagatgcggcgagggagagtggccttcctgtgggacctgggctccgggtccacacgcttggagtttccagactttcccattgatgacaacagatggcacagtatccatgtagccagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagaacagtgtgtggtggatgcagctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttccagctaacaaaaagcaaacaccgtatcactctgattgttgacggggacgcagttggcgcttgaaagtcacaacca

SEQ ID NO: 353582 - DNA, 8286 bp, Homo sapiens
  misc_feature (3667)..(3667): n is a, c, g, or t
  misc_feature (5720)..(5720): n is a, c, g, or t
  misc_feature (6098)..(6098): n is a, c, g, or t
cggggccagggcagcgcggactcgcgtcccgcggagcgttccaggcgggcgcgcggctttctccccagacccaccgagtggcggcggaggcgagatgcgcgggggcgtgctcctggtcttgctgctgtgtgtcgccgcgcagtgccggcagagaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagagaacgccatccaatatcacatgccatagatggcaccaataactggtggcaaagtcccagcattcagaatgggagagaatatcactgggtcacaatcactctggacttaagacaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttcgaacgcattagaacgctcaatgcagatctcatgacccttagccaccgggaacctaaagaactggatcctatgttaccaagacgctattattattcaataaaggacatttctgttggaggcatgtgtatctgctatggccatgctagtagctgcccatgggatgaaactacaaagaaactgcagtgtcaatgtgagcataatacttgcggggagagctgtaacaggtgctgtcctgggtaccatcagcagccctggaggccgggaaccgtgtcctccggcaatacatgtgaagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtgtctccttatgaggatgagccttgccgcccctgtaattgtgaccctgtggggtccctcagttctgtctgtattaaggatgacctccattctgacttagagaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctcttggtcaggtaaacagtatgtccgggtggctggtcaccgacttgatcagtcccaggaagatcccgtctcagcaagatgcactaggcgggcgccatcaggtcagcatcaacaacaccgcggtcatgcagagactggctcccaagtactactgggcagcccccgaggcctaccttggaaataagctgactgcgtttggcggattcctgaaatacacggtgtcctacgatattccggtagagacggtagacagtaacctcatgtcgcatgctgacgtcatcattaagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccacctacaattctgcaaaaatggctctttacaggttggagtccgtctctctggacatagccagctctaatgccatcgacctggtggtggctgctgatgtggagcactgtgaatgtccgcaaggctacacagggacctcctgtgagtcgtgcctctctggctattaccgcgtggatggaatactctttggaggaatttgtcaaccctgtgaatgccacggccatgcagctgagtgtaatgttcacggcgtttgcattgcgtgtgcgcacaacaccaccggcgtccactgtgagcagtgcttgcccggcttctacggggagccttcccgagggacacctggggactgccagccctgcgcctgccctctcaccatagcctccaacaatttcagccccacctgccacctcaatgatggagatgaagtggtctgtgactggtgtgccccgggctactcaggagcttggtgtgagagatgcgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgcgctgacgggttctatggggacgctgtgacagccaagaactgccgcgcctgtgaatgccatgtgaaaggctcccattctgccgtgtgccatcttgagaccgggctctgtgactgcaaaccaaacgtgactggacagcagtgtgaccagtgcttgcatggctattatgggctggactcaggccatggctgccggccctgcaactgcagcgtggcaggctccgtgtcagatggctgcacggatgaaggccagtgtcactgtgtcccaggtgtggcagggaaaaggtgtgacaggtgtgcccatggcttctacgcctaccaggatggtagctgtacaccctgtgactgcccacacactcagaatacctgcgacccagaaactggagagtgtgtctgcccccctcacacacagggtgtgaagtgtgaagaatgtgaggatgggcactggggctacgatgcggaggtggggtgccaggcctgcaattgcagtctcgtggggtcgactcatcatcggtgcgatgtggtcaccggccattgccagtgcaagtcaaaatttggtggccgggcctgcgtacagtgttccttgggttacagagactttcccgactgtgttccctgtgactgtgacctgagggggacgtcgggggacgcctgcaacctggagcagggtctctgcggctgtgtggaggaaaccggggcctgcccttgcaaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaacgctgggctccgatcagcctcttctgcgtgtggtttctcagagtaacttgaggggcacgacngagggggtttactaccaggcccccgacttcctgctggatgccgccaccgtccggcagcacatccgtgcagagccgttttactggcggctgccgcagcagttccaaggagaccagctcatggcctatggtggcaaactgaagtacagcgtggccttctattctttggatggcgtcggcacctccaattttgagcctcaagttctcatcaaaggtggtcggatcagaaagcaagtcatttacatggatgcaccagccccagagaatggagtgagacaggaacaagaagtagcaatgagagagaatttttggaaatattttaactctgtttctgaaaaacctgtcacgcgagaggattttatgtctgtcctcagcgatattgagtacatcctcatcaaggcatcgtatggtcaaggattacagcagagcagaatctcagacatttcaatggaggttggcagaaaggctgaaaagctgcacccagaagaagaggttgcatctcttttagagaattgtgtctgtcctcctggcactgtgggattctcatgtcaggactgcgcccctgggtaccacagagggaagctcccagcagggagtgacaggggaccacgccctctggttgctccttgtgttccctgcagttgcaacaaccacagtgacacctgtgaccccaacaccgggaagtgtctgaactgtggcgataacacagcaggtgaccattgtgatgtgtgtacttctggctactacgggaaggtgactggctcagcaagtgactgtgctctgtgtgcctgtcctcacagccctcctgccagttttagtcccacttgtgtcttggaaggggaccacgatttccgttgtgacgcctgtctcctgggctatgaaggaaaacactgtgaaaggtgctcctcaagctattatgggaaccctcaaacaccaggtggcagttgccagaagtgtgactgcaacccgcacggctctgtccacggtgactgtgaccgcacatctgggcagtgcgtttgcaggctgggggcctcggggctccggtgcgatgagtgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccgtagccattgagaggctgcagatgagcatcacagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaaggctgctgaagatttattgtcacaaattcaggaaaattaccagaagccgctggaagaattggaggtattgaaagaagcagcaagccatgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctgcatgttcaagaagaacaaaatctgacctcagagctcattgtccaaggaagaggattgatagatgctgctgctgcacaaacagatgctgtacaagatgctctagagcacttagaggatcaccaggataagctacttttatggtctgccaaaatcaggcaccacatagatgacctggtcatgcacatgtcccaaaggaacgcagtcgacctggtctacagagctgaggaccatgccnctgagttccagagactagcagatgttctgtacagtggccttgaaaacatcagaaatgtgtccctgaatgccaccagtgcagcctatgtccattacaacatccagagcctgattgaagaatcggaggaactggccagagatgctcacaggactgtgactgagacgagcctgctctcagaatcccttgtttctaacgggaaagcggccgtgcagcgcagctccagatttctaaaagaaggcaacaacctcagcaggaagcttccaggtattgcattggaactgagtgaattgagaaataagacaaacagatttcaagagaatgctgttgaaattaccaggcaaaccaatgaatcactcttgatacttagagcaattcctnaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccactctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctattaaagtcgccgtgtctgcagacagagattgcatccgggcctaccagcctcagatttcctctaccaactacaataccttaacactaaatgttaagacacaggaacccgataatcttctcttctacctcggtagcagcaccgcttctgatttccttgcagtggagatgcggcgagggagagtggccttcctgtgggacctgggctccgggtccacacgcttggagtttccagactttcccattgatgacaacagatggcacagtatccatgtagccagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggaggtacttgcacgcggccaggcagtgtgtaatgaaggtgtggtgagctcagagggaatgtgggaggaaccttgcggtggtgccctgggcggctagatgactggggtcatcggcatccagacgattctagaaccttgctaggattctttcctgggaaccagtttcatctgctttgtaataagatacttgtagaatttttataattaaacaactttagctctgccctttactggggcccagcataaattgtctttacattggattgattctgtggcaaatagtagtacactattagtaaatagtattatatcaatagtaaatagcattatatcaacattcctgtatatttccctccaaaatatagactgaatgctttaaaagcacactgggcattttcatcataggtaaagaggttaa

SEQ ID NO: 353583 - DNA, 855 bp, Homo sapiens
gcccttcccgcctggctcctcttgtctgcatcctgccctgtcagtgtggacctaggttcacactctgaggccctgcaaaacatgtcacctgtgggcacctccagttttccagtgcctggtccgcagctcgtctcggcagctgcatccttagggccattcccaaaacctcgggtcacggcgggggcctagggggacagcaaggcctttgccccttaagcctgatgaaaatttgtaggagagacttcagtgtccttatgaatttcagtgaagccgagtgggattaaggtgacagacagaagctctaagtgctttcttcagggagataaagcgctggcgagtgcatcatttaaaccgaagatggagtgagcgccaacaggcactggtggttgttgctgttctaatgggattgcttcgtagatggcccttcatggcggaacacgcgtgtgtcagtggggttcgggctgcgggtggcggctgagtgtccctgtgtgtctcttacaggaacagtgtgtggtggatgcagctctggagtacgttcccggcgctcaccagtttggtctcacacaaaacagccatttcatcttgccttttaatcagtcggctgtcagaaagaactgcctgtccctgggacccttctgccaagggaagatctcaaggcctggagcttggggctcccggactccatgttgctcctctctcctcctgaggtcctccagctcacctgccaggcttgcctgcagtctctgccatgccctgcccgtcttgttgtcattggctgtgccaccctgtcatacccccttagacctgggctcctgtctgtcttctgcagctcctgccatcactctctgtgaattc

SEQ ID NO: 353584 - DNA, 8550 bp, Homo sapiens
  misc_feature (3667)..(3667): n is a, c, g, or t
  misc_feature (5720)..(5720): n is a, c, g, or t
  misc_feature (6098)..(6098): n is a, c, g, or t
cggggccagggcagcgcggactcgcgtcccgcggagcgttccaggcgggcgcgcggctttctccccagacccaccgagtggcggcggaggcgagatgcgcgggggcgtgctcctggtcttgctgctgtgtgtcgccgcgcagtgccggcagagaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagagaacgccatccaatatcacatgccatagatggcaccaataactggtggcaaagtcccagcattcagaatgggagagaatatcactgggtcacaatcactctggacttaagacaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttcgaacgcattagaacgctcaatgcagatctcatgacccttagccaccgggaacctaaagaactggatcctatgttaccaagacgctattattattcaataaaggacatttctgttggaggcatgtgtatctgctatggccatgctagtagctgcccatgggatgaaactacaaagaaactgcagtgtcaatgtgagcataatacttgcggggagagctgtaacaggtgctgtcctgggtaccatcagcagccctggaggccgggaaccgtgtcctccggcaatacatgtgaagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtgtctccttatgaggatgagccttgccgcccctgtaattgtgaccctgtggggtccctcagttctgtctgtattaaggatgacctccattctgacttagagaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctcttggtcaggtaaacagtatgtccgggtggctggtcaccgacttgatcagtcccaggaagatcccgtctcagcaagatgcactaggcgggcgccatcaggtcagcatcaacaacaccgcggtcatgcagagactggctcccaagtactactgggcagcccccgaggcctaccttggaaataagctgactgcgtttggcggattcctgaaatacacggtgtcctacgatattccggtagagacggtagacagtaacctcatgtcgcatgctgacgtcatcattaagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccacctacaattctgcaaaaatggctctttacaggttggagtccgtctctctggacatagccagctctaatgccatcgacctggtggtggctgctgatgtggagcactgtgaatgtccgcaaggctacacagggacctcctgtgagtcgtgcctctctggctattaccgcgtggatggaatactctttggaggaatttgtcaaccctgtgaatgccacggccatgcagctgagtgtaatgttcacggcgtttgcattgcgtgtgcgcacaacaccaccggcgtccactgtgagcagtgcttgcccggcttctacggggagccttcccgagggacacctggggactgccagccctgcgcctgccctctcaccatagcctccaacaatttcagccccacctgccacctcaatgatggagatgaagtggtctgtgactggtgtgccccgggctactcaggagcttggtgtgagagatgcgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgcgctgacgggttctatggggacgctgtgacagccaagaactgccgcgcctgtgaatgccatgtgaaaggctcccattctgccgtgtgccatcttgagaccgggctctgtgactgcaaaccaaacgtgactggacagcagtgtgaccagtgcttgcatggctattatgggctggactcaggccatggctgccggccctgcaactgcagcgtggcaggctccgtgtcagatggctgcacggatgaaggccagtgtcactgtgtcccaggtgtggcagggaaaaggtgtgacaggtgtgcccatggcttctacgcctaccaggatggtagctgtacaccctgtgactgcccacacactcagaatacctgcgacccagaaactggagagtgtgtctgcccccctcacacacagggtgtgaagtgtgaagaatgtgaggatgggcactggggctacgatgcggaggtggggtgccaggcctgcaattgcagtctcgtggggtcgactcatcatcggtgcgatgtggtcaccggccattgccagtgcaagtcaaaatttggtggccgggcctgcgtacagtgttccttgggttacagagactttcccgactgtgttccctgtgactgtgacctgagggggacgtcgggggacgcctgcaacctggagcagggtctctgcggctgtgtggaggaaaccggggcctgcccttgcaaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaacgctgggctccgatcagcctcttctgcgtgtggtttctcagagtaacttgaggggcacgacngagggggtttactaccaggcccccgacttcctgctggatgccgccaccgtccggcagcacatccgtgcagagccgttttactggcggctgccgcagcagttccaaggagaccagctcatggcctatggtggcaaactgaagtacagcgtggccttctattctttggatggcgtcggcacctccaattttgagcctcaagttctcatcaaaggtggtcggatcagaaagcaagtcatttacatggatgcaccagccccagagaatggagtgagacaggaacaagaagtagcaatgagagagaatttttggaaatattttaactctgtttctgaaaaacctgtcacgcgagaggattttatgtctgtcctcagcgatattgagtacatcctcatcaaggcatcgtatggtcaaggattacagcagagcagaatctcagacatttcaatggaggttggcagaaaggctgaaaagctgcacccagaagaagaggttgcatctcttttagagaattgtgtctgtcctcctggcactgtgggattctcatgtcaggactgcgcccctgggtaccacagagggaagctcccagcagggagtgacaggggaccacgccctctggttgctccttgtgttccctgcagttgcaacaaccacagtgacacctgtgaccccaacaccgggaagtgtctgaactgtggcgataacacagcaggtgaccattgtgatgtgtgtacttctggctactacgggaaggtgactggctcagcaagtgactgtgctctgtgtgcctgtcctcacagccctcctgccagttttagtcccacttgtgtcttggaaggggaccacgatttccgttgtgacgcctgtctcctgggctatgaaggaaaacactgtgaaaggtgctcctcaagctattatgggaaccctcaaacaccaggtggcagttgccagaagtgtgactgcaacccgcacggctctgtccacggtgactgtgaccgcacatctgggcagtgcgtttgcaggctgggggcctcggggctccggtgcgatgagtgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccgtagccattgagaggctgcagatgagcatcacagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaaggctgctgaagatttattgtcacaaattcaggaaaattaccagaagccgctggaagaattggaggtattgaaagaagcagcaagccatgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctgcatgttcaagaagaacaaaatctgacctcagagctcattgtccaaggaagaggattgatagatgctgctgctgcacaaacagatgctgtacaagatgctctagagcacttagaggatcaccaggataagctacttttatggtctgccaaaatcaggcaccacatagatgacctggtcatgcacatgtcccaaaggaacgcagtcgacctggtctacagagctgaggaccatgccnctgagttccagagactagcagatgttctgtacagtggccttgaaaacatcagaaatgtgtccctgaatgccaccagtgcagcctatgtccattacaacatccagagcctgattgaagaatcggaggaactggccagagatgctcacaggactgtgactgagacgagcctgctctcagaatcccttgtttctaacgggaaagcggccgtgcagcgcagctccagatttctaaaagaaggcaacaacctcagcaggaagcttccaggtattgcattggaactgagtgaattgagaaataagacaaacagatttcaagagaatgctgttgaaattaccaggcaaaccaatgaatcactcttgatacttagagcaattcctnaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccactctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctattaaagtcgccgtgtctgcagacagagattgcatccgggcctaccagcctcagatttcctctaccaactacaataccttaacactaaatgttaagacacaggaacccgataatcttctcttctacctcggtagcagcaccgcttctgatttccttgcagtggagatgcggcgagggagagtggccttcctgtgggacctgggctccgggtccacacgcttggagtttccagactttcccattgatgacaacagatggcacagtatccatgtagccagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagtaggagcggcttcctttactatcagtcaggtccagtcagcaaaggagggcctaggacagagggagttaaaatggggccttgctgtaaaggtgcctgcgaaagctggagctggagctggagctggagctgtgctaaaaatcagagcggggacagggagggaaagggtgcctcaagcaactcagatgacacggcccaatccatagattgtaggccccaacacccaggccgcgcattgggctgatgtataatatgcttttggcagagcttctataaggactcattatcaatttacatttagccaggaaagcatgaaaataagtacttcatgtaaagccattgtgcacatatttgttgctttaaa

SEQ ID NO: 353585 - DNA, 2123 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353586 - DNA, 685 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagctgccaacccagagtcccctccacctgtggctgctggggtgaagggaggggtctgagagaagcctggccaccttttgaaaggggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaaggtaacccgcgcccgctgt

SEQ ID NO: 353587 - DNA, 2062 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353588 - DNA, 1950 bp, Homo sapiens
agccgagattgcaccactgtactccagcaaagcactgggattacagatgtgagccaccacgatgggcacagacagactttgtccgcccctagagctaagggggtcggtcagtccaaaagcttccaaggggtaggtcagagctgctgacccctgcttttttctgctttttcccccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353589 - DNA, 2039 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353590 - DNA, 1973 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcctatcatggcaattgacctctggggatgggggattcccctctggctagggctggc

SEQ ID NO: 353591 - DNA, 1622 bp, Homo sapiens
ctcgaatcccagggcagggagcagttggagaggggtgtgtggatgtggggaggcaaatgaagcccctctaattagtcccgtgctacagaggaagacaggctctgagaggtcaggtgatcggcctggcacagctcgatgtgaactcaggcctgagggcagagcccgtggtcacaccctggcctcactcttggactgtgtgggtccggtcacagggtctgagctccctgtccctcacacgtgattcctacttaatcaagatgtggagtagagagaaactgcagtctcaggctaaataaacaggccacctatgcccttggcagtgtggttacttagtagcttggggtgaaaacaagctgttgccaaaagggggaacctgtggttcctttctcaccaccccctcccccaaccttacctaaggtctcaaagatctttgtatttagtccacttggaccgaataaagaactgactggagtagaaggccctcagtttttgaagttttcccacctatttgaatgtgtagttgtgaagtgtgatgatagccatcaagctagtgagctgaaacgtctctttttgcttccaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353592 - DNA, 1087 bp, Homo sapiens
ccccacttgctaagtgggaataagccctagaccattatcctcacctcagcagacggacacctttctaaactcatgtcacttcacccaagtgtctgtacacactagacgctcaacaaatactaatccagcgactatccttgcccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353593 - DNA, 419 bp, Homo sapiens
cggggtggtctagagggtacccgaagaggaagtgaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353594 - DNA, 631 bp, Homo sapiens
accatctcactgttcctataaactccacatttctgccacttgctgagggacgccttgatctttgagtttacacagtgaggcaaaacataagaaagtgacagtatcctgtgtgcctaaagagaaagacatggcaagaataagagcacagagctgggcgcagtggcttacgcctgtaatcccagcactttggaaggccaaggtgggcagatcacctgaagtcgggagttcgagaccagcctgaccaacatggaaaaaccccgtctctactaaaaatacaaaattagctgggtgtggtggcgcatgcctgtaatcccagctactcaggaggctgaggcaggagaatcacttgaacccaggaggcagaggttgcagtgagccgagattgcaccactgtactccagcaaagcactgggattacagatgtgagccaccacgatgggcacagacagactttgtccgcccctagagctaagggggtcggtcagtccaaaagcttccaaggggtaggtcagagctgctgacccctgcttttttctgctttttcccccagggacaccacatcatttgaagcattctttcaatccaaggcatcgaattcttggacaggaaaggtagagtggtcgactaccct

SEQ ID NO: 353595 - DNA, 2088 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcct

SEQ ID NO: 353596 - DNA, 2150 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagacactgatgggcctctgtgccaaccagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353597 - DNA, 2240 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacagccccgctcctaccgctcagggtaccgcggctactccggcgccctgaccctcccctccatctcccccttgcaatacgacggctctgggcgctctgtccacttctatcatgggtcctaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353598 - DNA, 2667 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacagccccgctcctaccgctcagggtaccgcggctactccggcgccctgaccctcccctccatctcccccttgcaatacgacggctctgggcgctctgtccacttctatcatgggtcctaggccgcacgcctattttggaccagaagcctctgccagtaaattcaagctgctacatccggacttcatcagctacctgacagaaaggtacggagtggggtgcctgaagaacagcgtccccttccttcccccttttacacacccacccacatccagtcagcgccctcacacgtgattcctacttaatcaagatgtggagtagagagaaactgcagtctcaggctaaataaacaggccacctatgcccttggcagtgtggttacttagtagcttggggtgaaaacaagctgttgccaaaagggggaacctgtggttcctttctcaccaccccctcccccaaccttacctaaggtctcaaagatctttgtatttagtccacttggaccgaataaagaactgactggagtagaaggccctcagtttttgaagttttcccacctatttgaatgtgtagttgtgaagtgtgatgatagccatcaagctagtgagctgaaacgtctctttttgcttccaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353599 - DNA, 1041 bp, Homo sapiens
tgactctatgaggatcccctccagagcgtgtatgctgacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccattttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaacaggatgatgtcaccaggtaataaaccttcatcctcatatcatggcgtcagtaaatttgaactcagctga

SEQ ID NO: 353600 - DNA, 1916 bp, Homo sapiens
tccagccccgggggacccgccgcccagctcccgagggtgcggcagcctctggccactcagccggggccgagagggagctgccgggcggggaggcgccgcaggcacccggcgggcagggcggggcagggcaagacggccgcctccgcaagtgccacccggcccacccgggcctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacagccccgctcctaccgctcagggtaccgcggctactccggcgccctgaccctcccctccatctcccccttgcaatacgacggctctgggcgctctgtccacttctatcatgggtcctaggccgcacgcctattttggaccagaagcctctgccagtaaattcaagctgctacatccggacttcatcagctacctgacagaaaggtacggagtggggtgcctgaagaacagcgtccccttccttcccccttttacacacccacccacatccagtcagcgccctcacacgtgattcctacttaatcaagatgtggagtagagagaaactgcagtctcaggctaaataaacaggccacctatgcccttggcagtgtggttacttagtagcttggggtgaaaacaagctgttgccaaaagggggaacctgtggttcctttctcaccaccccctcccccaaccttacctaaggtctcaaagatctttgtatttagtccacttggaccgaataaagaactgactggagtagaaggccctcagtttttgaagttttcccacctatttgaatgtgtagttgtgaagtgtgatgatagccatcaagctagtgagctgaaacgtctctttttgcttccaggttcttgaaatcaaagttgattaacacacattttggagacctatatatgcctagtaccggggctctcatgctgctgacagctttgcatacctgtgaccaggtaagaggccttctcttccagaagcccatgccggcagaacacaggataacagaacccaacaggatcccctgatatcccttacctcggagctgggactcttggcctctgttcgtggaatccccagttccaagagtgctgctggtactgctcacttccttgcccacaaccctggggcctttgaaggacaggtc

SEQ ID NO: 353601 - DNA, 354 bp, Homo sapiens
gggataagacaggcaaagaggtataaccttcaagagtatgatgtgatgcccaaattccctctaatttcaggctctgtcagccacctcaatgcaaatttccctgaataaattccactaggctacatagtcatttgcatggtaatattaatgagctctcgttgcctgtgccacctctctaccccaaagttttctacccctgcccaagagcaaattttattaaggaggaaaagaatacaagggtatcagcttacaaacttggtgaggtgggattggggacattaccaataaggaaaagcaaaattgaagagcagtgtatcttcacttatatgcaagactggagtgctgccagtcagg

SEQ ID NO: 353602 - DNA, 320 bp, Homo sapiens
gctattgcctgaaaacttaccaactctcaaagtaaggctgcctctgacctgccaacctgggacactctgattggctgctggtgatgtcacaggaatctctgggagatgattggtgggtgagagcccctaggtcaggtggaaggagggcttgatggttagggctggtgtctgtggcatgttcacagaggccgacccaggagctagctgaggacgaacaggtgcctaaggggcccccatctttgttggggcgacccctcctcctaaccccactcacagcagccagcgatgaccatggccccttctcacttgatagcatctgg

SEQ ID NO: 353603 - DNA, 989 bp, Homo sapiens
ccacagccctgcgcctgcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353604 - DNA, 872 bp, Homo sapiens
atgaggtttttaaactcacgttttattaatgggtaggcaggtaacatgatgattaggagttctggcatcagattactgggttgaaatcctggctttgtcacttgctagtgaggatgaaataataaaatccctctaaaatacctagctcagcacctgacacatggttattacttaattaatgttacaggcatttgtgacctagaaaagacatagtttaatgactatatttttagccttcaaaaaatgcaaattccatgatttatttgagttctcatatattagagaatatgttaattgtctcagtttgttgttttattttttctgcccagcagtctttcagttggtagagtggactgttaatttatctatttctctggtatttagttatgccaatttagggtatttggatttcacataattttcaatcctgtctgacatttcagatgacagtagaaagaaaacgtagcacttatagatctctccatgtaccctgcagggggcttggtactgtgaaatgagtaacttaatcctgacaaccgtagtgcaaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353605 - DNA, 602 bp, Homo sapiens
tgtaatagtttactgttgtaattcgtttataccatgtgttggacaactcagctaatatgttaattgatttatacaattcctttcaattttatctaaaaataagcagaccaaaattaaataagaaagttacataagattccatttgagcatacataaggccatgatactttaatgtgaaccaccatttcttggaagaaagaagacatccaaatgtccgattcagagagaaagttcctggccagtcatccagtagactctctccactcttcaatgggaaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353606 - DNA, 1094 bp, Homo sapiens
ccacagccctgcgcctgcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcagatgacagtagaaagaaaacgtagcacttatagatctctccatgtaccctgcagggggcttggtactgtgaaatgagtaacttaatcctgacaaccgtagtgcaaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353607 - DNA, 935 bp, Homo sapiens
ccacagccctgcgcctgcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctcttttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353608 - DNA, 740 bp, Homo sapiens
ccacagccctgcgcctgcgcgtgggcctgggccgcccgtcgtacctgatggtaggaggcagtagttccccgcttcccttccgcgggagggagagttaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353609 - DNA, 1839 bp, Homo sapiens
tgtaatagtttactgttgtaattcgtttataccatgtgttggacaactcagctaatatgttaattgatttatacaattcctttcaattttatctaaaaataagcagaccaaaattaaataagaaagttacataagattccatttgagcatacataaggccatgatactttaatgtgaaccaccatttcttggaagaaagaagacatccaaatgtccgattcagagagaaagttcctggccagtcatccagtagactctctccactcttcaatgggaaggtgatgcttatatttttaaaaatctctacaaagctcacatacaacaagacagtacatcctagatttgtgactgatatgagcatttaaggctgtcattttcaagtataaaagtttagtgttccattacccaatctgtgcagtagacatagctataagctcaagtcatgtgaattaacagaagcccaccaaagacatttaaaaaattataatttgggcaacagcaagtttaaatgtaggaaaggctagaaaaaatgtgatgagattgtttctctaaaatgcattaggttgttcacaatgaagctttgtctaacaccattatctgatgcatccattatctgatgcatggcatatgcaataaggcagatccacagcagaccaaacaaggaagctgaattaggtaatagaactagtaattaagatggttcacctctaacacagttctgtggcctgttccccccagagaaagattagaaatggctccagtgtaccaaataagcttcacagaagaacatgaaaattttcctccaacttttttttcttttttttttcaagcagagcctttcacttagggaccaactgcttgtagatgaaataaatcaacattaattacttctagcctgatgtaatatggctggagaaaaggggtctctggaagccggtattttgtttaacttacattctaggtgtgtatataagttgtcgctctataacttctgctgtggttccaacatctatatctgaaaggtggaagcagctgctctgttacaattttcatgtaacacgcttggattctaggtctttcctctttaacacaacttaaagaaagtttcttgtggtttggtcagcatacacacttctcatttcatttgatgtacacagccaaagtggaattaaaaaaaaaaaattaccaactagttcagagagctaaattgagtctatcattatggcaaagtctgacccaaaattttaatttgtaattttagcatgtgtctcatgcactttggggagcgtcaaactaaatctacaattgccagaagccttgttacagtttaatgcacattaactaaaatgtgtacatttttagtgttcatgataaatgcagttatgaccttattacacttttggcattctttaagaaagcacattaagctttaatatagaaatatttaggttacacttgtgctcaagtaataataaaacatttgttcttttttgatctcatacattctctcctcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353610 - DNA, 1041 bp, Homo sapiens
ccacagccctgcgcctgcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcagggggcttggtactgtgaaatgagtaacttaatcctgacaaccgtagtgcaaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353611 - DNA, 740 bp, Homo sapiens
cgcccgtcgtacctgatggtaggaggcagtagttccccgcttcccttccgcgggagggagagttaggtaagccccgctggacgccctcggcgctctcgcctcacgaggtgcaagctacccccgcgaattgccgaagcagccctgagccttggcgccccgacccgccggcgctcgccgtcagctcagcgccactcttccggcgtgccctgatggacagaccccctttcggatccgagttttcgcctctgtcccccagttttcccttgtcttcaactcccatgctctttgatcctgcctctcagctggttcctcgctgcccacgcttgcgccggcgtaggctcgggcagaatcccgagggacccgggttggggtggggctgccggtgaaggtgcggcgatgcccgcgaaggctcctctgggtgccgctcggaagagccttctctccgctgcggtgcgtagcgaggtgggccgggtcatgcccgtggcacttctgcaggcgtcctgggggcacgccagggcctaaccggtgctggttccctctttgcttactctggttccttcattcattcagcaaacatttgagtttgggtcctgctcactgtattacatccacatctgctgctggcagctgcgattccgagggtggctcagaaaaatcgctgaagggctatctgttgagagaatggattcctgatccccttgccctccctcaatcagcttaagatagaatctatgggaaac

SEQ ID NO: 353612 - DNA, 1373 bp, Homo sapiens
ccacagccctgcgcctgcgcgtgggcctgggccgcccgtcgtacctgatggtaggaggcagtagttccccgcttcccttccgcgggagggagagttaggtaagccccgctggacgccctcggcgctctcgcctcacgaggtgcaagctacccccgcgaattgccgaagcagccctgagccttggcgccccgacccgccggcgctcgccgtcagctcagcgccactcttccggcgtgccctgatggacagaccccctttcggatccgagttttcgcctctgtcccccagttttcccttgtcttcaactcccatgctctttgatcctgcctctcagctggttcctcgctgcccacgcttgcgccggcgtaggctcgggcagaatcccgagggacccgggttggggtggggctgccggtgaaggtgcggcgatgcccgcgaaggctcctctgggtgccgctcggaagagccttctctccgctgcgctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353613 - DNA, 1112 bp, Homo sapiens
ccacagccctgcgcctgcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcagaagcagatagcaaggtaatttttgcagcagcggcctgtgttatcaagaaagctcacaaacatcagatttttcgtcttgtatcacaataagataaagctgatatgctaggtaaagcactgtgaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagaaaaaaacttcagatgct

SEQ ID NO: 353614 - DNA, 1869 bp, Homo sapiens
cccaacgcgcaggcgccgctgctatgctgagtgccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggcatgtacaacgccaccacccggcaggtggaaacggagctcttcccctgcctcaggcactttggactgaggttctatgcctacaaccctctggctgggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaaaccacacaaaaaaaaaaaaaaaaaagcacccgcttctgtggcgcgccagcccccagaaaacacctcaaacacccaatggagtggcacacggcaccaatgagaacgcaccacgggccaacaagggacacaaagaaacccggcacaacaaaggcgggctcccacagaaaaaaaaggccggggaacacagaaggcgtctgaaacaaaccgacaggagagacgaggaacacaagcgggacccacacaggagaccaagagaagtcaaaaaagacccgacggggtggtttgcaccgggagaaaacacagcgacgaagagaaaagaaagcgagggcgacacagagaaaggcggcagagacagaggacgcgccaaaggaagcgacaaacgacgggggaccgaagagcagagcaaaacaacgagggagacaagagcgtacgcgacgacaggcgcgaagaaaacagcgcgagagcccgacgcagaggaacaagaaaggccgaggaggagaggaaga

SEQ ID NO: 353615 - DNA, 3017 bp, Homo sapiens
cccaacgcgcaggcgccgctgctatgctgagtgccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaacttgctttctctgctgttaacactttgtttcccatcctacctggggactgagaaagggcagaaccatgggctggagtcttcagagggcagaggtagtaggagggtcacagaagcacactgccctcccagggtctcctcgggcccctggtctgaatacccacctgacctctcaacattgaggtgtctctcactcttctacacacgatagaaaagagagtcatacacctgcagtacattttctctaattcagagttgcctcaatacattcttaggaatgaaacaactgggacaaagaaactaccattagagtcactaccaagaagaagaacacttcccaggatctgtggaacatcttgaagctctcaatcttagcctcctcttgtcttaactaaagcctcttgtcttttcacccattaggttctcagtcttggctctgggcctcctgttcggcatggggacagacataggcagccaaggtcctcatttcccttggaaacccctactccaaacaggaggcaccaaggctgagaataagaatccttggttcagtggttgctgaacctgctgcattcccagtgcaccaaaatccctccagccatgggcagggcagcaggcagcacttggagcagcttcttgaagcaatgaaagaggcccaacctggaaatttactttttcatttatatttattatttgttcttgagacaggctcttgctctgtcacctagaccggagtacagtggcatgatcactgctcacagcaattttgacctccggggctcaagggatcctcccacctcagcctcccgagaagtttttatttttattttttttgtggagtggagatctccctatgttgtcaccgtcttttctgtttacccgtaacaaaacagatgctcacccatgtggaatggtgtatcagttatctttgcacaacaaaccacactaataagttgcttgaaaagataaaatccaaggctggcacagtggctcatggctataatcccagcacgttgagagcccaaagcaggcagatcacttgagctcaggagtttgagaccagcctgggcaacatggtgaaaccctgtctctaccaaaaatacaaaaaattaatctgtgtgtggtggcacatacctgtggtcccagctactctggaggctgaggtgggaggatcgcctgggccccggaaacagaggttgcagtgggccgagatcatgccattacactctagcctgggtgacacagtcagacccatctcaaaaaaaaaaaaaaatcttattgatcaaaagatttgatataattcctattattcccagctgactttttcttaatactgaaattgacaaactaatcctaaagctcatatggaaattcaagggacccaggagaaccaaaacagtcttgaaaaacacatagttggaggacttatactttctgatttcaaaacttactacaaagctacagtaataaagacaatggttctggcataagaatagagcaactgaacagaactgagagtccagaaataaactcttactgattttagagttgagtgacaactcaatagggacagttcaatagggaaaagaatcatcttcaccaacatccagatgtcctcctgtgaaagagtgaagttggaccccttccccataccataaacaaaaaattaactcgaatcaccatctaaatgtataaggtaaactataaaactcttagaagaaaatacttgagtcaagtgtgactttggattaggc

SEQ ID NO: 353616 - DNA, 1949 bp, Homo sapiens
ctatacggttgtgagaagacgacagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaacttgctttctctgctgttaacactttgtttcccatcctacctggggactgagaaagggcagaaccatgggctggagtcttcagagggcagaggtagtaggagggtcacagaagcacactgccctcccagggtctcctcgggcccctggtctgaatacccacctgacctctcaacattgaggtgtctctcactcttctacacacgatagaaaagagagtcatacacctgcagtacattttctctaattcagagttgcctcaatacattcttaggaatgaaacaactgggacaaagaaactaccattagagtcactaccaagaagaagaacacttcccaggatctgtggaacatcttgaagctctcaatcttagcctcctcttgtcttaactaaagcctcttgtcttttcacccattaggttctcagtcttggctctgggcctcctgttcggcatggggacagacataggcagccaaggtcctcatttcccttggaaacccctactccaaacaggaggcaccaaggctgagaataagaatccttggttcagtggttgctgaacctgctgcattcccagtgcaccaaaatccctccagccatgggcagggcagcaggcagcacttggagcagcttcttgaagcaatgaaagaggcccaacctggaaatttactttttcatttatatttattatttgttcttgagacaggctcttgctctgtcacctagaccggagtacagtggcatgatcactgctcacagcaattttgacctccggggctcaagggatcctcccacctcagcctcccgagaagtttttatttttattttttttgtggagtggagatctccctatgttgtcaccgtcttttctgtttacccgtaacaaaacagatgctcacccatgtggaatggtgtatcagttatctttgcacaacaaaccacactaataagttgcttgaaaagataaaatccaaggctggcacagtggctcatggctataatcccagcacgttgagagcccaaagcaggcagatcacttgagctcaggagtttgagaccagcctgggcaacatggtgaaaccctgtctctaccaaaaatacaaaaaattaatctgtgtgtggtggcacatacctgtggtcccagctactctggaggctgaggtgggaggatcgcctgggccccggaaacagaggttgcagtgggccgagatcatgccattacactctagcctgggtgacacagtcagacccatctcaaaaaaaaaaaaaaatcttattgatcaaaagatttgatataattcctattattcccagctgactttttcttaatactgaaattgacaaactaatcctaaagctcatatggaaattcaagggacccaggagaaccaaaacagtcttgaaaaacacatagttggaggacttatactttctgatttcaaaacttactacaaagctacagtaataaagacaatggttctggcataagaatagagcaactgaacagaactgagagtccagaaataaactcttactgattttagagttgagtgacaactcaatagggacagttcaatagggaaaagaatcatcttcaccaacatccagatgtcctcctgtgaaagagtgaagttggaccccttccccataccataaacaaaaaattaactcgaatcaccatctaaatgtataaggtaaactataaaactcttagaagaaaatacttgagtcaagtgtgactttggattaggc

SEQ ID NO: 353617 - DNA, 900 bp, Homo sapiens
cccaacgcgcaggcgccgctgctatgctgagtgccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggaggtcactgaagcggctgcagtgtccctgagtggacctcttctatctacatgcacctgaccacagcgccccggtggaagagacactgcgtgcctgccaccagctgcaccaggagggcaagttcgtggagcttggcctctccaactatgccgcctgggaagtggccgagatctgtaccctctgcaagagcaacggctggatcctgcccactgtgtaccagggcatgtacagcgccaccacccggcaggtggaaacggagctcttcccctgcctcaggcactttggactgaggttctatgcctacaaccctctggctgggggcctgctgaccggcaagtacaagtatgaggacaaggacgggaaacagcccgtgggccgcttctttgggactcag

SEQ ID NO: 353618 - DNA, 304 bp, Homo sapiens
ggcaagttcgtggagcttggcctctccaactatgctagctgggaagtggccgagatctgtaccctctgcaagagcaatggctggatcctgcccactgtgtaccaggtgagggccggggctgcagaggccaaggtctccaggactcctgctaatcctgggctctctttgcccccctgactgccccctgtgccgtctgcatagcagccactcccctgctgaaagcctgcagatggctcccatgtaccctcaggatgccattcaagctcctcagcctggccactgggcatctgcttccttcctgcct

SEQ ID NO: 353619 - DNA, 3114 bp, Homo sapiens
cccaacgcgcaggcgccgctgctatgctgagtgccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggcatgtacaacgccaccacccggcaggtggaaacggagctcttcccctgcctcaggcactttggactgaggttctatgcctacaaccctctggctgggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaacttgctttctctgctgttaacactttgtttcccatcctacctggggactgagaaagggcagaaccatgggctggagtcttcagagggcagaggtagtaggagggtcacagaagcacactgccctcccagggtctcctcgggcccctggtctgaatacccacctgacctctcaacattgaggtgtctctcactcttctacacacgatagaaaagagagtcatacacctgcagtacattttctctaattcagagttgcctcaatacattcttaggaatgaaacaactgggacaaagaaactaccattagagtcactaccaagaagaagaacacttcccaggatctgtggaacatcttgaagctctcaatcttagcctcctcttgtcttaactaaagcctcttgtcttttcacccattaggttctcagtcttggctctgggcctcctgttcggcatggggacagacataggcagccaaggtcctcatttcccttggaaacccctactccaaacaggaggcaccaaggctgagaataagaatccttggttcagtggttgctgaacctgctgcattcccagtgcaccaaaatccctccagccatgggcagggcagcaggcagcacttggagcagcttcttgaagcaatgaaagaggcccaacctggaaatttactttttcatttatatttattatttgttcttgagacaggctcttgctctgtcacctagaccggagtacagtggcatgatcactgctcacagcaattttgacctccggggctcaagggatcctcccacctcagcctcccgagaagtttttatttttattttttttgtggagtggagatctccctatgttgtcaccgtcttttctgtttacccgtaacaaaacagatgctcacccatgtggaatggtgtatcagttatctttgcacaacaaaccacactaataagttgcttgaaaagataaaatccaaggctggcacagtggctcatggctataatcccagcacgttgagagcccaaagcaggcagatcacttgagctcaggagtttgagaccagcctgggcaacatggtgaaaccctgtctctaccaaaaatacaaaaaattaatctgtgtgtggtggcacatacctgtggtcccagctactctggaggctgaggtgggaggatcgcctgggccccggaaacagaggttgcagtgggccgagatcatgccattacactctagcctgggtgacacagtcagacccatctcaaaaaaaaaaaaaaatcttattgatcaaaagatttgatataattcctattattcccagctgactttttcttaatactgaaattgacaaactaatcctaaagctcatatggaaattcaagggacccaggagaaccaaaacagtcttgaaaaacacatagttggaggacttatactttctgatttcaaaacttactacaaagctacagtaataaagacaatggttctggcataagaatagagcaactgaacagaactgagagtccagaaataaactcttactgattttagagttgagtgacaactcaatagggacagttcaatagggaaaagaatcatcttcaccaacatccagatgtcctcctgtgaaagagtgaagttggaccccttccccataccataaacaaaaaattaactcgaatcaccatctaaatgtataaggtaaactataaaactcttagaagaaaatacttgagtcaagtgtgactttggattaggc

SEQ ID NO: 353620 - DNA, 3050 bp, Homo sapiens
gcgcgcggctcctgggctgtcacagtctcccgttgccgccgtcatgtcccggcagctgtcgcgggcccggccagcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacgcacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggcatgtacaacgccaccacccggcaggtggaaacggagctcttcccctgcctcaggcactttggactgaggttctatgcctacaaccctctggctgggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaacttgctttctctgctgttaacactttgtttcccatcctacctggggactgagaaagggcagaaccatgggctggagtcttcagagggcagaggtagtaggagggtcacagaagcacactgccctcccagggtctcctcgggcccctggtctgaatacccacctgacctctcaacattgaggtgtctctcactcttctacacacgatagaaaagagagtcatacacctgcagtacattttctctaattcagagttgcctcaatacattcttaggaatgaaacaactgggacaaagaaactaccattagagtcactaccaagaagaagaacacttcccaggatctgtggaacatcttgaagctctcaatcttagcctcctcttgtcttaactaaagcctcttgtcttttcacccattaggttctcagtcttggctctgggcctcctgttcggcatggggacagacataggcagccaaggtcctcatttcccttggaaacccctactccaaacaggaggcaccaaggctgagaataagaatccttggttcagtggttgctgaacctgctgcattcccagtgcaccaaaatccctccagccatgggcagggcagcaggcagcacttggagcagcttcttgaagcaatgaaagaggcccaacctggaaatttactttttcatttatatttattatttgttcttgagacaggctcttgctctgtcacctagaccggagtacagtggcatgatcactgctcacagcaattttgacctccggggctcaagggatcctcccacctcagcctcccgagaagtttttatttttattttttttgtggagtggagatctccctatgttgtcaccgtcttttctgtttacccgtaacaaaacagatgctcacccatgtggaatggtgtatcagttatctttgcacaacaaaccacactaataagttgcttgaaaagataaaatccaaggctggcacagtggctcatggctataatcccagcacgttgagagcccaaagcaggcagatcacttgagctcaggagtttgagaccagcctgggcaacatggtgaaaccctgtctctaccaaaaatacaaaaaattaatctgtgtgtggtggcacatacctgtggtcccagctactctggaggctgaggtgggaggatcgcctgggccccggaaacagaggttgcagtgggccgagatcatgccattacactctagcctgggtgacacagtcagacccatctcaaaaaaaaaaaaaaatcttattgatcaaaagatttgatataattcctattattcccagctgactttttcttaatactgaaattgacaaactaatcctaaagctcatatggaaattcaagggacccaggagaaccaaaacagtcttgaaaaacacatagttggaggacttatactttctgatttcaaaacttactacaaagctacagtaataaagacaatggttctggcataagaatagagcaactgaacagaactgagagtccagaaataaactcttactgattttagagttgagtgacaactcaatagggacagttcaatagggaaaagaatcatcttcaccaacatccagatgtcctcctgtgaaagagtgaagttggaccccttccccataccataaacaaaaaattaactcgaatcaccatctaaatgtataaggtaaactataaaactcttagaagaaaatacttgagtcaagtgtgactttggattaggc

SEQ ID NO: 353621 - DNA, 343 bp, Homo sapiens
cttaccctaatgagaaggaaccacaaaaccaatgctggtaatatgacaaaataaggctcttgaacagcaccccccaaaatcacactagtttaccagcaatggatccaacccaagaagaaatccctgatttacctgaaaaagaattcaggaggttagttattaagctaatcagggaggcaccagagaaaggtgaagctcaatgcaaggaaatccaaaaaacgatacaagaagtgacgggagaaatagccaagaaaatagatagcttaaagaaaaaaaaataaataaaaaatccaggaaaaattggacacacttatagtaatgcaaaatgctctggaaagtctca

SEQ ID NO: 353622 - DNA, 979 bp, Homo sapiens
agttgatgacgcacccatggcgcctggttgtctagacgagccggtgtaccgactccccggtggatgataactatgagtgcaaaagcaagacgcgcactttcctgtcacctcgccctttcaccccctcgggaagatcaaagtgtctttagcccaagcatggccttgagcgacttcatcacacctgcatgaggtcacaagcagtcactagcgcaggggggtgaggcgagttctgggtgaaagaaacggggcggggctgaggccaaggaagaggttggactgtgtctcgcatgctcctgacgcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagta

SEQ ID NO: 353623 - DNA, 2607 bp, Homo sapiens
gtttcgcagaggggcgggctcgctacctcgctcgcgcaggcactgcagattctcccaggccagtggatcccgagccaactcggccgggcgctggaggcaggtggcgagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagtaaatattctttatccctttttttgttgttgttttaaccaagatttaaatgtcaaatttaatacagcaactcagttctacatttggggtgttgtagaagggccttaaaaagaattattttaggccaggcacggtggctcatgcctgtaatcccagcactttgggaggccgaggcaggtggatcacgtgaggtcaggagttcgagaccagcctgaccaacatggtgaaacactgtctctactaaaaacacaaaaattagctgagcatggtggctcacgcctgtaatcccagctactcaggaggctgaggcaggggaatcgcttgaacctgagaagtggaggttgtggtgagctgagatcatgccactgcactttagcctgggtgacagagcgagactctgtctcaaaaaaaaaaaaaaaaaaagaattatttctctgaagtctacaaccactgtggtcttcccttccttctgtcgtagcaagacctcagaatctagcataacttaggctaggtttggctagatgctttctgggtataagccagagtcgtatagtgcaactttgctgtgaccttagtgaacatcccctcttgaggactacaaaaacaaacgtaactttttaaaattattatggagaattttacgtaaaacaaaagtagacaggctagtctaatgaactcccatgtatcattacccagcatcaactatttatgactaatcttacctacttctactttgtcttattgaattaattttggagcagatcttagaaatagaatttaatctataaaaatcttggtgggctgggtacggtggctcatgcctgtaatcccagcactttgggaggctgaggtgggtggatcacctgaggtcaggagtccaagaccagcctggccaatgtggtgaaactccatctcttctaaaaatacaaaaattagctggtcttggtggcgggcgcctgtaatcccagctacttgggaggctgaggcaggagaattgcttgaacccaggaagcagaggttgcagtgagctgagacggtgccattgctctccagcctgggcgacaagagcgaaactccgtctcaaaaaaaaaaaagaaaagaaaaagaaaaaaaaaatcttggtatactggctgggcacagtggctcacacctaatcccagcactttgggaggctgaggcaggaggatagcttgaggctgggagttcaaaaccagcctgggcaacatagcaagaccccatctctaccaaaaaaaatttttttaaagatttcaggtatatttctcaaaaagataaggactgtcaattgtctactcccccccaacaaaggtcactaaggaaacctgttgactaaacaaagctcattaaacctattgtagtgtagcaaaggagaccatcaacttgacacagagtcttggtaatgattcaaagggaggatgttagagtaaggtatttataaggatttgagataagggtccaactggtttaaaatgagtcaaaatagggaactagtagagactgagaaagggttgtgaatagcttaggtttggtaaacttaggaaatcaacagttttaattttaatatggttaaactgattagtatttcctatttttttatctactgtgtaagaagaccctataatatatgggcattactgagagatactgcccatatgttgtcctcgtaagcaaggagatattttttatctcccatatattacctttcaaacctttgttactttagtttcgagatatagatccagtttatgttgttactcagtagtgaggaagtttcttttttttttttaaatggctatcaagttgtccccccattagttattgaaaagaccataattttttcactcctattcaatgccatttttattgtaaataaactatgtacatgt

SEQ ID NO: 353624 - DNA, 912 bp, Homo sapiens
agttgatgacgcacccatggcgcctggttgtctagacgagccggtgtaccgactccccggtggatgataactatgagtgcaaaagcaagacgcgcactttcctgtcacctcgccctttcaccccctcgggaagatcaaagtgtctttagcccaagcatggccttgagcgacttcatcacacctgcatgaggtcacaagcagtcactagcgcaggggggtgaggcgagttctgggtgaaagaaacggggcggggctgaggccaaggaagaggttggactgtgtctcgcatgctcctgacgcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccaggatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagta

SEQ ID NO: 353625 - DNA, 706 bp, Homo sapiens
gtttcgcagaggggcgggctcgctacctcgctcgcgcaggcactgcagattctcccaggccagtggatcccgagccaactcggccgggcgctggaggcaggtggcgagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagta

SEQ ID NO: 353626 - DNA, 2880 bp, Homo sapiens
agttgatgacgcacccatggcgcctggttgtctagacgagccggtgtaccgactccccggtggatgataactatgagtgcaaaagcaagacgcgcactttcctgtcacctcgccctttcaccccctcgggaagatcaaagtgtctttagcccaagcatggccttgagcgacttcatcacacctgcatgaggtcacaagcagtcactagcgcaggggggtgaggcgagttctgggtgaaagaaacggggcggggctgaggccaaggaagaggttggactgtgtctcgcatgctcctgacgcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccagtttggacactactttgaaacaacatatgatacaagctacaacaacaaaatgccactttcaacacatagatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagtaaatattctttatccctttttttgttgttgttttaaccaagatttaaatgtcaaatttaatacagcaactcagttctacatttggggtgttgtagaagggccttaaaaagaattattttaggccaggcacggtggctcatgcctgtaatcccagcactttgggaggccgaggcaggtggatcacgtgaggtcaggagttcgagaccagcctgaccaacatggtgaaacactgtctctactaaaaacacaaaaattagctgagcatggtggctcacgcctgtaatcccagctactcaggaggctgaggcaggggaatcgcttgaacctgagaagtggaggttgtggtgagctgagatcatgccactgcactttagcctgggtgacagagcgagactctgtctcaaaaaaaaaaaaaaaaaaagaattatttctctgaagtctacaaccactgtggtcttcccttccttctgtcgtagcaagacctcagaatctagcataacttaggctaggtttggctagatgctttctgggtataagccagagtcgtatagtgcaactttgctgtgaccttagtgaacatcccctcttgaggactacaaaaacaaacgtaactttttaaaattattatggagaattttacgtaaaacaaaagtagacaggctagtctaatgaactcccatgtatcattacccagcatcaactatttatgactaatcttacctacttctactttgtcttattgaattaattttggagcagatcttagaaatagaatttaatctataaaaatcttggtgggctgggtacggtggctcatgcctgtaatcccagcactttgggaggctgaggtgggtggatcacctgaggtcaggagtccaagaccagcctggccaatgtggtgaaactccatctcttctaaaaatacaaaaattagctggtcttggtggcgggcgcctgtaatcccagctacttgggaggctgaggcaggagaattgcttgaacccaggaagcagaggttgcagtgagctgagacggtgccattgctctccagcctgggcgacaagagcgaaactccgtctcaaaaaaaaaaaagaaaagaaaaagaaaaaaaaaatcttggtatactggctgggcacagtggctcacacctaatcccagcactttgggaggctgaggcaggaggatagcttgaggctgggagttcaaaaccagcctgggcaacatagcaagaccccatctctaccaaaaaaaatttttttaaagatttcaggtatatttctcaaaaagataaggactgtcaattgtctactcccccccaacaaaggtcactaaggaaacctgttgactaaacaaagctcattaaacctattgtagtgtagcaaaggagaccatcaacttgacacagagtcttggtaatgattcaaagggaggatgttagagtaaggtatttataaggatttgagataagggtccaactggtttaaaatgagtcaaaatagggaactagtagagactgagaaagggttgtgaatagcttaggtttggtaaacttaggaaatcaacagttttaattttaatatggttaaactgattagtatttcctatttttttatctactgtgtaagaagaccctataatatatgggcattactgagagatactgcccatatgttgtcctcgtaagcaaggagatattttttatctcccatatattacctttcaaacctttgttactttagtttcgagatatagatccagtttatgttgttactcagtagtgaggaagtttcttttttttttttaaatggctatcaagttgtccccccattagttattgaaaagaccataattttttcactcctattcaatgccatttttattgtaaataaactatgtacatgt

SEQ ID NO: 353627 - DNA, 2813 bp, Homo sapiens
agttgatgacgcacccatggcgcctggttgtctagacgagccggtgtaccgactccccggtggatgataactatgagtgcaaaagcaagacgcgcactttcctgtcacctcgccctttcaccccctcgggaagatcaaagtgtctttagcccaagcatggccttgagcgacttcatcacacctgcatgaggtcacaagcagtcactagcgcaggggggtgaggcgagttctgggtgaaagaaacggggcggggctgaggccaaggaagaggttggactgtgtctcgcatgctcctgacgcagaaggttttgaaccttttttcacctcgtctgaaatggctgcctcccagtgtctctgctgctcaaaatttctcttccagagacagaacctcgcctgtttcctcacaaacccacactgtggcagccttgttaatgcagatggccatggtgaagtgtggacagattggaataatatgtccaagtttttccagtatggatggcgatgcaccactaatgagaatacctattcaaaccgtaccctgatgggcaactggaaccaggaaagatatgacctgaggaatatcgtgcagcccaaacccttgccttcccaggatttaagcgagagcctcactggttcccaggacatcaacctgaactggatcctccccgatacaaatgcacagaaaagtcaacttacatgaatagctattcaaagccttaaattgggcatcactcaggatgtgtataagatcttaatattgactagtttcacatccaggtttctaagaaatgataagatacttcacttttccagagtgaaatgtaggagggagcacattctaagtacagctaaaaatttagctcactgtaacacagtttcactctctgaataaataaagcaaaaaacacagtaaatattctttatccctttttttgttgttgttttaaccaagatttaaatgtcaaatttaatacagcaactcagttctacatttggggtgttgtagaagggccttaaaaagaattattttaggccaggcacggtggctcatgcctgtaatcccagcactttgggaggccgaggcaggtggatcacgtgaggtcaggagttcgagaccagcctgaccaacatggtgaaacactgtctctactaaaaacacaaaaattagctgagcatggtggctcacgcctgtaatcccagctactcaggaggctgaggcaggggaatcgcttgaacctgagaagtggaggttgtggtgagctgagatcatgccactgcactttagcctgggtgacagagcgagactctgtctcaaaaaaaaaaaaaaaaaaagaattatttctctgaagtctacaaccactgtggtcttcccttccttctgtcgtagcaagacctcagaatctagcataacttaggctaggtttggctagatgctttctgggtataagccagagtcgtatagtgcaactttgctgtgaccttagtgaacatcccctcttgaggactacaaaaacaaacgtaactttttaaaattattatggagaattttacgtaaaacaaaagtagacaggctagtctaatgaactcccatgtatcattacccagcatcaactatttatgactaatcttacctacttctactttgtcttattgaattaattttggagcagatcttagaaatagaatttaatctataaaaatcttggtgggctgggtacggtggctcatgcctgtaatcccagcactttgggaggctgaggtgggtggatcacctgaggtcaggagtccaagaccagcctggccaatgtggtgaaactccatctcttctaaaaatacaaaaattagctggtcttggtggcgggcgcctgtaatcccagctacttgggaggctgaggcaggagaattgcttgaacccaggaagcagaggttgcagtgagctgagacggtgccattgctctccagcctgggcgacaagagcgaaactccgtctcaaaaaaaaaaaagaaaagaaaaagaaaaaaaaaatcttggtatactggctgggcacagtggctcacacctaatcccagcactttgggaggctgaggcaggaggatagcttgaggctgggagttcaaaaccagcctgggcaacatagcaagaccccatctctaccaaaaaaaatttttttaaagatttcaggtatatttctcaaaaagataaggactgtcaattgtctactcccccccaacaaaggtcactaaggaaacctgttgactaaacaaagctcattaaacctattgtagtgtagcaaaggagaccatcaacttgacacagagtcttggtaatgattcaaagggaggatgttagagtaaggtatttataaggatttgagataagggtccaactggtttaaaatgagtcaaaatagggaactagtagagactgagaaagggttgtgaatagcttaggtttggtaaacttaggaaatcaacagttttaattttaatatggttaaactgattagtatttcctatttttttatctactgtgtaagaagaccctataatatatgggcattactgagagatactgcccatatgttgtcctcgtaagcaaggagatattttttatctcccatatattacctttcaaacctttgttactttagtttcgagatatagatccagtttatgttgttactcagtagtgaggaagtttcttttttttttttaaatggctatcaagttgtccccccattagttattgaaaagaccataattttttcactcctattcaatgccatttttattgtaaataaactatgtacatgt

SEQ ID NO: 353628 - DNA, 2342 bp, Homo sapiens
agcggggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgtggaggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagttgggcctgaggctggggagaaccagaagcagccggaaaaaaatgctggtcccacagccaggacatcagccacagtgccggtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgaggagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctgagtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcaacgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaaaaaaaaaaaag

SEQ ID NO: 353629 - DNA, 1607 bp, Homo sapiens
agcggggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgtggaggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagttgggcctgaggctggggagaaccagaagcagccggaaaaaaatgctggtcccacagccaggacatcagccacagtgccggtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgaggagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactataaaatctgcttttcacactgggtgataata

SEQ ID NO: 353630 - DNA, 1561 bp, Homo sapiens
agcggggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgtggaggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagttgggcctgaggctggggagaaccagaagcagccggaaaaaaatgctggtcccacagccaggacatcagccacagtgccggtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgaggagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagcacaacctggaacagcacaacctggacca

SEQ ID NO: 353631 - DNA, 2445 bp, Homo sapiens
agcggggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgtggaggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagttgggcctgaggctggggagaaccagaagcagccggaaaaaaatgctggtcccacagccaggacatcagccacagtgccggtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgagggtaaactgtggcttattcttacaaaaagtgtaataaaggagactgacccctgacaacatggtaggcactgtatacatacttgtttttgttttttgttttttagagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctgagtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcaacgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaaaaaaaaaaaag

SEQ ID NO: 353632 - DNA, 1581 bp, Homo sapiens
ccggggaaggaaagaaggcgccgcagctaagcccaggtctctcctccgcaggttccagctcctttcctggagcgtgtgtgtggaggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagttgggcctgaggctggggagaaccagaagcagccggaaaaaaatgctggtcccacagccaggacatcagccacagtgccggtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgaggagacggactctatgttgcccaggctgttatggaactcctgagtcaagtgatcctcccaccttggcctctgaaggtgcgaggattataggcgtcacctaccacatccagcctacacgtatttgttaatatctaacataggactaaccagccactgccctctcttaggcccctcatttaaaaacggttatactataaaatctgcttttcacactgggtgataataacttggacaaattctatgtgtattttgttttgttttgctttgctttgttttgagacggagtctcgctctgtcatccaggctggagtgcagtggcatgatctcggctcactgcaacccccatctcccaggttcaagcgattctcctgcctcctcctgagtagctgggactacaggtgctcaccaccacacccggctaattttttgtatttttagtagagacggggtttcaccatgttgaccaggctggtctcgaactcctgacctggtgatctgcccacccaggcctcccaaagtgctgggattaaaggtgtgagccaccatgcctggccctatgtgtgttttttaactactaaaaattatttttgtaatgattgagtcttctttatggaaacaactggcctcagcccttgcgcccttactgtgattcctggcttcattttttgctgatggttccccctcgtcccaaatctctctcccagtacaccagttgttcctcccccacctcagccctctcctgcatcctcctgtacccgcaacgaaggcctgggctttcccaccctccctccttagcaggtgccgtgctgggacaccatacgggttggtttcacctcctcagtcccttgcctaccccagtgagagtctgatcttgtttttattgttattgcttttattattattgcttttattatcattaaaactctagttcttgttttgtctctccgaaaaaaaaaaaag

SEQ ID NO: 353633 - DNA, 1522 bp, Homo sapiens
agcggggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgtggaggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccaccctcccagtaggatcactgtcctcggacaaagagctcactcgtcccaatgaaaccaccattcacactgcgggccacagtctggcagttgggcctgaggctggggagaaccagaagcagccggaaaaaaatgctggtcccacagccaggacatcagccacagtgccggtcctgtgcctcctggccatcatcttcatcctcaccgcagccctttcctatgtgctgtgcaagaggaggagggggcagtcaccgcagtcctctccagatctgccggttcattatatacctgtggcacctgactctaatacctgagccaagaatggaagcttgtgaggagacggactctatgttgcccaggctgttatggaactcctgagtcaagtgatcctcccaccttggcctctgaaggtgcgaggattataggcgtcacctaccacatagttcagctctgacggtaccgagctcgattctct

SEQ ID NO: 353634 - DNA, 1226 bp, Homo sapiens
agcggggtgcgtccgcgggtggctgccccgcaggtgcgcgcggccggggctggcggcgactctctccaccgggccgcccgggaggctcatgcagcgcggctgggtcccgcggcgcccggatcggggaagtgaaagtgcctcggaggaggagggccggtccggcagtgcagccgcctcacaggtcggcggacgggccaggcgggcggcctcctgaaccgaaccgaatcggctcctcgggccgtcgtcctcccgcccctcctcgcccgccgccggagttttctttcggtttcttccaagattcctggccttccctcgacggagccgggcccagtgcgggggcgcagggcgcgggagctccacctcctcggctttccctgcgtccagaggctggcatggcgcgggccgagtactgagcgcacggtcggggcacagcagggccggggggtgcagctggctcgcgcctcctctccggccgccgtctcctccggtccccggcgaaagccattgagacaccagctggacgtcacgcgccggagcatgtctgggagtcagagcgaggtggctccatccccgcagagtccgcggagccccgagatgggacgggacttgcggcccgggtcccgcgtgctcctgctcctgcttctgctcctgctggtgtacctgactcagccaggcaatggcaacgagggcagcgtcactggaagttgttattgtggtaaaagaatttcttccgactccccgccatcggttcagttcatgaatcgtctccggaaacacctgagagcttaccatcggtgtctatactacacgaggttccagctcctttcctggagcgtgtgtgtggaggcaacaaggacccatgggttcaggaattgatgagctgtcttgatctcaaagaatgtggacatgcttactcggggattgtggcccaccagaagcatttacttcctaccagccccccaatttctcaggcctcagagggggcatcttcagatatccacacccctgcccagatgctcctgtccaccttgcagtccactcagcgccccatctctactaaaaatacaaaaattagctgggcgtggtggcacgcatctgtagtcccagctactcaggaggctgagacaagagaatcgcttgaacatgggaggcggaggttgcagtgagctgagattgcaccattgcactccagcctgggcgacagagcgtgaccctctctcaaaaca

SEQ ID NO: 353635 - DNA, 435 bp, Homo sapiens
gcaggttattccgattctcatcacacactaacaaaaaaaaaaattcaacaaaatgagggaaagaaactatcatggcaccatcctcaagcatgaacaatttctaagagtctggagaaaagcaggagggaaggcaaaccacaaagaagaaacctcaaaataggtgactgccttcctttcatcacgaagggccattcaaattttctgcccatgcctccagggactcccctatggctgctgcagctgataaagatgcatccaagaaaacttccaaggaatggtcaatgtgtggcacagctaactcagtgaaggccaaactgctgaagaatctatttgtcttaactagctgaattcaccaatctgtttcccaaaaacttggtttgagaaatattttcctgtaatatcttcagtgaataaaagatcttattcttataaata

SEQ ID NO: 353636 - DNA, 645 bp, Homo sapiens
gcaggttattccgattctcatcacacactaacaaaaaaaaaaattcaacaaaatgagggaaagaaactatcatggcaccatcctcaagcatgaacaatttctaagagtctggagaaaagcaggagggaaggcaaaccacaaagaagaaacctcaaaatagaaaatgccatgatcatatcagattccttatggatgactttcgcctttccacctggatagcccagatcagcttcaacctagaaaacattcatcagcagttttagttgctgcagcacagctctatttagagttatgcacatcccataagatttaaatgtaggataagaagaaaatgtagcagcagcagcagcagcagcagcaagaaaaaagggtgactgccttcctttcatcacgaagggccattcaaattttctgcccatgcctccagggactcccctatggctgctgcagctgataaagatgcatccaagaaaacttccaaggaatggtcaatgtgtggcacagctaactcagtgaaggccaaactgctgaagaatctatttgtcttaactagctgaattcaccaatctgtttcccaaaaacttggtttgagaaatattttcctgtaatatcttcagtgaataaaagatcttattcttataaata

SEQ ID NO: 353637 - DNA, 588 bp, Homo sapiens
gcaggttattccgattctcatcacacactaacaaaaaaaaaaattcaacaaaatgagggaaagaaactatcatggcaccatcctcaagcatgaacaatttctaagagtctggagaaaagcaggagggaaggcaaaccacaaagaagaaacctcaaaatagaaaatgccatgatcatatcagattccttatggatgactttcgcctttccacctggatagcccagatcagcttcaacctagaaaacattcatcagcagttttagttgctgcagcacagctctatttagagttatgcacatcccataagatttaaatgtaggataagaagaaaatgtagcagcagcagcagcagcagcagcaagaaaaaaggggactcccctatggctgctgcagctgataaagatgcatccaagaaaacttccaaggaatggtcaatgtgtggcacagctaactcagtgaaggccaaactgctgaagaatctatttgtcttaactagctgaattcaccaatctgtttcccaaaaacttggtttgagaaatattttcctgtaatatcttcagtgaataaaagatcttattcttataaata

SEQ ID NO: 353638 - DNA, 1519 bp, Homo sapiens
gcaggttattccgattctcatcacacactaacaaaaaaaaaaattcaacaaaatgagggaaagaaactatcatggcaccatcctcaagcatgaacaatttctaagagtctggagaaaagcaggagggaaggcaaaccacaaagaagaaacctcaaaataggtgactgccttcctttcatcacgaagggccattcaaattttctgcccatgcctccagggactcccctatggctgctgcagctgataaagatgcatccaagaaaacttccaaggaatggtcaatgtgtggcacagctaactcagtgaaggccaaactgctgaagaatctatttgtcttaactagctgaattcaccaatctgtttcccaaaaacttggtttgagaaatattttcctgtaatatcttcagtgaataaaagatcttattcttataaataaatatataacttcagcatttctcagggattttttttaaatgcacccagcatttttaggattagcctgccaattttattggtcaattttctgaatttgccaaatttagtgattaccaaaatcctatttgacaattttaaagatgtaagcactcttactggattgggtagagttttagtaagttttgcatatttctgagcctaacgacgagtttttattttgtcctaacagccttaatgttttattcataatttttttcttaataaaacaccttttttttcagatctgagctattcaaaacagcaatcactaaccatatgtaactatttaaatttagatcaattaaaattaaaattcagtttctcaatcatgctagccacatttcaagtactcagtaaccacatgtggctggtgactactatgttggactatgcagatacagatttccatcatcacagaaagttctatgggacagtactggacaagacagtaattccattcaatgttttaaaattaaaagggtacatgataaaaattcttccatcctaactcccagccatgtacttcccttccttggagccaactgatgcttatatagcactttaagaaacattccgtttatctctgtcctacttccctgttcatggggacccactgctggaagaaaaatagaacacacagagactgaggggcataatggaagggagactaaggggcggagagggggagaattagttaaggaagaagcaaactcgtggggaagggcaagacgagaatgggagggtccaagaaacccagacacctggcttcccacagcactctacactctgacaagtcaaccagtcaagctgctatcaaccttaccaatacttaaaacatacttgtgataaatcattaattttaataatttgaagaacaaaacactcagaaaattgatcactcaatgaactggttttctgtgaataacagagcccctaattgaccagaaatcttattgattaagacagggtctcactttgttacccaggatggagtgcagtggtgtgtgatctcagctcactacaacctccacctcctgggctcaag

SEQ ID NO: 353639 - DNA, 1462 bp, Homo sapiens
gcaggttattccgattctcatcacacactaacaaaaaaaaaaattcaacaaaatgagggaaagaaactatcatggcaccatcctcaagcatgaacaatttctaagagtctggagaaaagcaggagggaaggcaaaccacaaagaagaaacctcaaaataggtgactgccttcctttcatcacgaagggccattcaaattttctgcccatgcctccagggactcccctatggctgctgcagctgataaagatgcatccaagaaaacttccaaggaatggtcaatgtgtggcacagctaactcagtgaaggccaaactgctgaagaatctatttgtcttaactagctgaattcaccaatctgtttcccaaaaacttggtttgagaaatattttcctgtaatatcttcagtgaataaaagatcttattcttataaataaatatataacttcagcatttctcagggattttttttaaatgcacccagcatttttaggattagcctgccaattttattggtcaattttctgaatttgccaaatttagtgattaccaaaatcctatttgacaattttaaagatgtaagcactcttactggattgggtagagttttagtaagttttgcatatttctgagcctaacgacgagtttttattttgtcctaacagccttaatgttttattcataatttttttcttaataaaacaccttttttttcagatctgagctattcaaaacagcaatcactaaccatatgtaactatttaaatttagatcaattaaaattaaaattcagtttctcaatcatgctagccacatttcaagtactcagtaaccacatgtggctggtgactactatgttggactatgcagatacagatttccatcatcacagaaagttctatgggacagtactggacaagacagtaattccattcaatgttttaaaattaaaagggtacatgataaaaattcttccatcctaactcccagccatgtacttcccttccttggagccaactgatgcttatatagcactttaagaaacattccgtttatctctgtcctacttccctgttcatggggacccactgctggaagaaaaatagaacacacagagactgaggggcataatggaagggagactaaggggcggagagggggagaattagttaaggaagaagcaaactcgtggggaagggcaagacgagaatgggagggtccaagaaacccagacacctggcttcccacagcactctacactctgacaagtcaaccagtcaagaatttgaagaacaaaacactcagaaaattgatcactcaatgaactggttttctgtgaataacagagcccctaattgaccagaaatcttattgattaagacagggtctcactttgttacccaggatggagtgcagtggtgtgtgatctcagctcactacaacctccacctcctgggctcaag

SEQ ID NO: 353640 - DNA, 722 bp, Homo sapiens
acctctctgtttcactatctagaaacaccagtgcccctccgctgtcacctctgcagctgtccttgcccccactttctaagccagcacaaagcatgttagcagttacacttccccttggatagggtggcttttcatatgcagcagtacatttttgatggtcaacaatcggtatgtcgacatacattagatttctagcaagaaaacccctttgggttaatccccatccagatgcagttccaatgtcatctgtcctcataaaggattcagcttcttttcttggcagacaaataggcgtgatgttgctattgattacaactttgttattcaatttaatcagtgctatgtcattgtcaaagccagcatcatgagtataaccttcatgtataaaaacagcttcagaccaggcttgtgtataatgaggtgatagtcttttcagggtgcccattcgaatgtccagggcagatgcatcatgtttttgctcatagacggcatgagcagctgttaggacccagttgtcatataaaagtgcacctgctgctgtggttccacctaatatcaggacttgccaaggaaaatcaccaggttttgccttttgccctccatatatacgccctcctgttgtgcgggctgatagtccacaaactggagaaagaagcagataggtagagagcctttgtaaaaatgtcaatcgtgtttttcttaaattatgaccgccttgaagt

SEQ ID NO: 353641 - DNA, 1581 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataa

SEQ ID NO: 353642 - DNA, 1527 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataa

SEQ ID NO: 353643 - DNA, 3035 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacatgttttaaacatttatcaatgaagtcatcctttagacttgtaatcgccacattgtttcattattcagtttcctctgtaaagggatcttgagttgttttaattttttttttctgcatctgaatctgcatgatttccaaaccctgtaccatctgaattttgcattttagcacttgcactattactcagcagcagtaacatggtaacacttaaaatggtactcggggacctccaaagactaaactgacaagccttcaaggagcccaggggtaagttaacttgtcaacggcatggtttaatcccttctttacacttgtgtaaatttcagttactggtcatagaaggctttcaatgttgagtggccttttattaacatgtttatggtactgcatagatacgggtatttattttaccctaagaagattttgaagtttaaaagtacttaaactatttggcaaagatttgtttttaaaaatctatttggtcaatctaaatgcattcattctaaaaaattttttgaaccagataaataaaatttttttttgacaccaca

SEQ ID NO: 353644 - DNA, 670 bp, Homo sapiens
tgcagtgactcacacctgtaatcccagcactttgggaggccaaggcaagcggatcacctgaggtcaggagttcaagaccagcgtggccaacatggcgaacgaaaccccatctctactaaaaaatacaaaattagccgggcttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataa

SEQ ID NO: 353645 - DNA, 4085 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacatgttttaaacatttatcaatgaagtcatcctttagacttgtaatcgccacattgtttcattattcagtttcctctgtaaagggatcttgagttgttttaattttttttttctgcatctgaatctgcatgatttccaaaccctgtaccatctgaattttgcattttagcacttgcactattactcagcagcagtaacatggtaacacttaaaatggtactcggggacctccaaagactaaactgacaagccttcaaggagcccaggggtaagttaacttgtcaacggcatggtttaatcccttctttacacttgtgtaaatttcagttactggtcatagaaggctttcaatgttgagtggccttttattaacatgtttatggtactgcatagatacgggtatttattttaccctaagaagattttgaagtttaaaagtacttaaactatttggcaaagatttgtttttaaaaatctatttggtcaatctaaatgcattcattctaaaaaattttttgaaccagataaataaaatttttttttgacaccacagtttagtgtctggagtcttactggaaaaacacgatttctttttatatgtgatatacagatgctggaaagttacctttaaaaattgagtctctaaagaaaaaagaaaataataaaaattgagtctcaagaagttgtacttcatatgcacaagagaaatgaggccaagactcacaatatggaatttcactactgttgcccaggctagagtataatggtgcgatctgggctcaccgcaacctccaccacctgggttcaagcaattctgcctcagccgctcgagtagctgggattacaggcatgtaccaccacacccggctaattttgtatttttattagagacggggtttctccatgctggtcaggctggcctcaggtgacccacctgcctcggcctcccaaagtgctgggattacaggcgtgagccacacctggcctaaaaatcatttaattttttatgcttgcctagttataaggtcaaagagaatcaaatgactgatgcagtcagcacctaacaacctctgtatatgggaagggggtaatgagaacatactatttggaaataataacagcctaagagccaagtgctgaagttacatttctgcctaccacagctaaagctctcctcactgtctcctacccagtcctcctttccatcaattaccagtctcttgtataaatgtatccattaccaggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaaagtggaaaccttttagatgtgtaacttgaatatgtatcaagatctcaagtgcttaatgataaggtgttgacttgttaaattaaaccatttggaatacaaaaaaaaa

SEQ ID NO: 353646 - DNA, 2964 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatgcacttgcactattactcagcagcagtaacatggtaacacttaaaatggtactcggggacctccaaagactaaactgacaagccttcaaggagcccagggatgctggaaagttacctttaaaaattgagtctctaaagaaaaaagaaaataataaaaattgagtctcaagaagttgtacttcatatgcacaagagaaatgaggccaagactcacaatatggaatttcactactgttgcccaggctagagtataatggtgcgatctgggctcaccgcaacctccaccacctgggttcaagcaattctgcctcagccgctcgagtagctgggattacaggcatgtaccaccacacccggctaattttgtatttttattagagacggggtttctccatgctggtcaggctggcctcaggtgacccacctgcctcggcctcccaaagtgctgggattacaggcgtgagccacacctggcctaaaaatcatttaattttttatgcttgcctagttataaggtcaaagagaatcaaatgactgatgcagtcagcacctaacaacctctgtatatgggaagggggtaatgagaacatactatttggaaataataacagcctaagagccaagtgctgaagttacatttctgcctaccacagctaaagctctcctcactgtctcctacccagtcctcctttccatcaattaccagtctcttgtataaatgtatccattaccaggctcacagactgggagtgatttttctcctttggagctcgtccagaatccatcagcctcacacacatatttacctgcaaatcattggaaaagcaaaaatgtttaactgcatgtataagatggttgtcatttgcttgaatacccccttgaaaaatgttgattcttgagcatcagtgggacatagaggtgtctgaagaaccattttacatgatttcataaataggaggtctctgcattaccatgtttgcttgcaaagtggaaaccttttagatgtgtaacttgaatatgtatcaagatctcaagtgcttaatgataaggtgttgacttgttaaattaaaccatttggaatacaaaaaaaaa

SEQ ID NO: 353647 - DNA, 2256 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatgcacttgcactattactcagcagcagtaacatggtaacacttaaaatggtactcggggacctccaaagactaaactgacaagccttcaaggagcccaggggtaagttaacttgtcaacggcatggtttaatcccttctttacacttgtgtaaatttcagttactggtcatagaaggctttcaatgttgagtggccttttattaacatgtttatggtactgcatagatacgggtatttattttaccctaagaagattttgaagtttaaaagtacttaaactatttggcaaagatttgtttttaaaaatctatttggtcaatctaaatgcattcattctaaaaaattttttgaaccagataaataaaatttttttttgacaccaca

SEQ ID NO: 353648 - DNA, 1729 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaag

SEQ ID NO: 353649 - DNA, 1995 bp, Homo sapiens
  misc_feature (1718)..(1719): n is a, c, g, or t
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaaaaaaaaaaaaaaaaaaaannaatttgtgggccctttggccccatttttttttaattttggaaaatttatttttggggcccaaatttgggcttattttggcaaattcccctattaggggggatataaaaatacaggggccggttttacaaccgcggggggggggaaaaccgtggggtccccaaattataaggtttaaaaaacacccctttgccaagtgggaataaaaaaaaaggcccccccaacccccttcccaagttggcccccttaggggaaggaaaatttggcttttttttgaa

SEQ ID NO: 353650 - DNA, 1924 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataaaaaaaaaaaaaaagggcggcccggacgcgtgggtcgacccaggcgtccgtgcagcgcaagtaggtctacaagacgctacttccccgtatcatagaagagcttatcaccatttaatgatcacgccctcataatcatttcctaatcggcttcctagatccgtgtaatgacccttttcctaacaactccacaaagaaaatctcacctaatactaacatctcagaacgctcaggcaaatagaacccggtttgaatatcctggccgacataatcacaagtcctcatggacactcccattcactaagcatcctttacataccagacgaggttctagatcccttccctac

SEQ ID NO: 353651 - DNA, 2639 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaaccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacatgttttaaacatttatcaatgaagtcatcctttagacttgtaatcgccacattgtttcattattcagtttcctctgtaaagggatcttgagttgttttaattttttttttctgcatctgaatctgcatgatttccaaaccctgtaccatctgaattttgcattttagcacttgcactattactcagcagcagtaacatggtaacacttaaaatggtactcggggacctccaaagactaaactgacaagccttcaaggagcccaggggtaagttaacttgtcaacggcatggtttaatcccttctttacacttgtgtaaatttcagttactggtcatagaaggctttcaatgttgagtggccttttattaacatgtttatggtactgcatagatacgggtatttattttaccctaagaagattttgaagtttaaaagtacttaaactatttggcaaagatttgtttttaaaaatctatttggtcaatctaaatgcattcattctaaaaaattttttgaaccagataaataaaatttttttttgacaccaca

SEQ ID NO: 353652 - DNA, 1487 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtgttacggagggtcgttacggaggcgctcgtta

SEQ ID NO: 353653 - DNA, 1592 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttacccccttcacacgtgactgtggccacctcccgccaagctgatggcgtggagcaccatggacatagtttgtggtgcagctccgcaggggcacttgaagcggagttcaccaaggaggttaggagtcccaaaaaagggcgggagttctaaagccggatagccccccaggagaacaccgatgcccgggcccctgcgtctcgagatcggaggccatggataagggtcccccagggtgtttatttttccccacagccgttctttattggtttaaaa

SEQ ID NO: 353654 - DNA, 1428 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatgcacttgcactattactcagcagcagtaacatggtaacacttaaaatggtactcggggacctccaaagactaaactgacaagccttcaaggagcccagggatgctggaaagttacctttaaaaattgagtctctaaagaaaaaagaaaataataaaaattgagtctcaagaagttgtacttcatatgcacaagagaaatgaggccaagactcacagtaagcttttacatggaatggtaacttttagttagactgaaaaacttgaatgttagctattaaaaccttttagga

SEQ ID NO: 353655 - DNA, 3063 bp, Homo sapiens
aataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaattcgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacatgttttaaacatttatcaatgaagtcatcctttagacttgtaatcgccacattgtttcattattcagtttcctctgtaaagggatcttgagttgttttaattttttttttctgcatctgaatctgcatgatttccaaaccctgtaccatctgaattttgcattttagcacttgcactattactcagcagcagtaacatggtaacacttaaaatggtactcggggacctccaaagactaaactgacaagccttcaaggagcccaggggtaagttaacttgtcaacggcatggtttaatcccttctttacacttgtgtaaatttcagttactggtcatagaaggctttcaatgttgagtggccttttattaacatgtttatggtactgcatagatacgggtatttattttaccctaagaagattttgaagtttaaaagtacttaaactatttggcaaagatttgtttttaaaaatctatttggtcaatctaaatgcattcattctaaaaaattttttgaaccagataaataaaatttttttttgacaccacaaaaaaaaaaagtcgacgcggccgcgaat

SEQ ID NO: 353656 - DNA, 5204 bp, Homo sapiens
ctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctaccttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaacacaacaaccaacaaaaaaaaaaaacaacaaaacaaaacaaaaaaaaaaaaaaaaaaacaaaaaaaaaaggggggggccaaaaaaattcccccgggggccccatttggcccccttttttgtcacaaagaggctccactataagagacctctccttaaaaaaagacagaacgtcctgccatcatattataaacaacgtcgctatcagaggaaaaaaactctacctactgtaacaatctttgggaaaaaagcaccccacatttttctaagagagacacaaaatggggagacacacccatcagaaagattaacacatcactcagtgaaaataccaacattaagagattatagtgtataaaccactgtgtatttactccgccagaaacttttgcaagacgaattatcgaaaatttaacagggat

SEQ ID NO: 353657 - DNA, 5093 bp, Homo sapiens
ctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctaccttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaagaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaacacaacaaccaacaaaaaaaaaaaacaacaaaacaaaacaaaaaaaaaaaaaaaaaaacaaaaaaaaaaggggggggccaaaaaaattcccccgggggccccatttggcccccttttttgtcacaaagaggctccactataagagacctctccttaaaaaaagacagaacgtcctgccatcatattataaacaacgtcgctatcagaggaaaaaaactctacctactgtaacaatctttgggaaaaaagcaccccacatttttctaagagagacacaaaatggggagacacacccatcagaaagattaacacatcactcagtgaaaataccaacattaagagattatagtgtataaaccactgtgtatttactccgccagaaacttttgcaagacgaattatcgaaaatttaacagggat

SEQ ID NO: 353658 - DNA, 5151 bp, Homo sapiens
ctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctaccttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaacacaacaaccaacaaaaaaaaaaaacaacaaaacaaaacaaaaaaaaaaaaaaaaaaacaaaaaaaaaaggggggggccaaaaaaattcccccgggggccccatttggcccccttttttgtcacaaagaggctccactataagagacctctccttaaaaaaagacagaacgtcctgccatcatattataaacaacgtcgctatcagaggaaaaaaactctacctactgtaacaatctttgggaaaaaagcaccccacatttttctaagagagacacaaaatggggagacacacccatcagaaagattaacacatcactcagtgaaaataccaacattaagagattatagtgtataaaccactgtgtatttactccgccagaaacttttgcaagacgaattatcgaaaatttaacagggat

SEQ ID NO: 353659 - DNA, 4048 bp, Homo sapiens
gttctagacacaggagttactgacacacaattggtagtgacatcttcaggcagaacatattaattgaaaatagaaaagagtgtgaagaactaataaactagaattttaggatacatcaatatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaacacaacaaccaacaaaaaaaaaaaacaacaaaacaaaacaaaaaaaaaaaaaaaaaaacaaaaaaaaaaggggggggccaaaaaaattcccccgggggccccatttggcccccttttttgtcacaaagaggctccactataagagacctctccttaaaaaaagacagaacgtcctgccatcatattataaacaacgtcgctatcagaggaaaaaaactctacctactgtaacaatctttgggaaaaaagcaccccacatttttctaagagagacacaaaatggggagacacacccatcagaaagattaacacatcactcagtgaaaataccaacattaagagattatagtgtataaaccactgtgtatttactccgccagaaacttttgcaagacgaattatcgaaaatttaacagggat

SEQ ID NO: 353660 - DNA, 3532 bp, Homo sapiens
ctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctaccttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctggcctgcagatacttataaaaaaaggggtaaaaaaagaggtaaaaaaaagtcccccccgc

SEQ ID NO: 353661 - DNA, 1476 bp, Homo sapiens
cataaacccacttacctttacacaaaacaggagttagcctatcccttctgccttaaattctggttctcacttccttgctaataaatgtcccttgtggctttcttttttcccccccagaatagggcacttttatctgaattaaaaatttgttcaggttgggcactgtagctcatacctacactcccaaagtgctgggattacaggtgtgaacactgtgcctggccaaaagtagaaaatttttatggtcttaattggctaataggtatattgctagatagatgaccctttgcttgttaattttgaaattataatacatttagcactgaaattatactgaatataataatatattttggaagactttttaaagttttttttttgttttgagatagagtctcactctgtcacccaagctggagtgcagtggcacgatctcggctcactacagcctccatctcccagtattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaacacaacaaccaacaaaaaaaaaaaacaacaaaacaaaacaaaaaaaaaaaaaaaaaaacaaaaaaaaaaggggggggccaaaaaaattcccccgggggccccatttggcccccttttttgtcacaaagaggctccactataagagacctctccttaaaaaaagacagaacgtcctgccatcatattataaacaacgtcgctatcagaggaaaaaaactctacctactgtaacaatctttgggaaaaaagcaccccacatttttctaagagagacacaaaatggggagacacacccatcagaaagattaacacatcactcagtgaaaataccaacattaagagattatagtgtataaaccactgtgtatttactccgccagaaacttttgcaagacgaattatcgaaaatttaacagggat

SEQ ID NO: 353662 - DNA, 2170 bp, Homo sapiens
ctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctaccttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcagcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctggcctgcagatacttataaaaaaaggggtaaaaaaagaggtaaaaaaaagtcccccccgc

SEQ ID NO: 353663 - DNA, 465 bp, Homo sapiens
tctgcaatctcaatctaaagacaaatctacgacaccaggttacgtatttataaaaaatttagttattgctgattatattcaggatatctattctcagcattttaaatattcaattgtgaatggtacagcaatgatttgccagggccaatgcctgaatgttccaaatgagacctcagctttagttgattcaatgaatatttattaacgtagactagcctacttactggttaaaggacttaatatgttacattttaacagtttaaacatgctttttccaggatgatcatgctagattttttttctatattttttgattcagacaaagcatgtttaactggaaatcacattttaggggcataatggagaaacattcttgtagccaagtgtgcagagcagtgcttctcaatcttgagtatgaaggcacctctaatagcagagggaagtgaatgtgcatgcaaatgactc

SEQ ID NO: 353664 - DNA, 276 bp, Homo sapiens
atttttatgtctagctaggaacaataataaatgttaaatatgtttctctaagcccagtgtaactaaattttaacttttaaataatagctttttaatatttaatttgtaccaacttaaatgctgcttaatgcttactgacttaaatagtcttattttctactaatttctcttaatttgtttttaaagaatcccataggaaggataaatctggctaattgtaccagtcgtcagatagaaccagccaacagagaattttgtgcaagacgcaacactttt

SEQ ID NO: 353665 - DNA, 5156 bp, Homo sapiens
ctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctaccttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagtattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaacacaacaaccaacaaaaaaaaaaaacaacaaaacaaaacaaaaaaaaaaaaaaaaaaacaaaaaaaaaaggggggggccaaaaaaattcccccgggggccccatttggcccccttttttgtcacaaagaggctccactataagagacctctccttaaaaaaagacagaacgtcctgccatcatattataaacaacgtcgctatcagaggaaaaaaactctacctactgtaacaatctttgggaaaaaagcaccccacatttttctaagagagacacaaaatggggagacacacccatcagaaagattaacacatcactcagtgaaaataccaacattaagagattatagtgtataaaccactgtgtatttactccgccagaaacttttgcaagacgaattatcgaaaatttaacagggat

SEQ ID NO: 353666 - DNA, 5150 bp, Homo sapiens
ctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctaccttctccagtgaaatctactacatctatcactgatgctaaaagttgtgagggacaaaatcctgagctacttccaaaaactcctattagtcttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaacacaacaaccaacaaaaaaaaaaaacaacaaaacaaaacaaaaaaaaaaaaaaaaaaacaaaaaaaaaaggggggggccaaaaaaattcccccgggggccccatttggcccccttttttgtcacaaagaggctccactataagagacctctccttaaaaaaagacagaacgtcctgccatcatattataaacaacgtcgctatcagaggaaaaaaactctacctactgtaacaatctttgggaaaaaagcaccccacatttttctaagagagacacaaaatggggagacacacccatcagaaagattaacacatcactcagtgaaaataccaacattaagagattatagtgtataaaccactgtgtatttactccgccagaaacttttgcaagacgaattatcgaaaatttaacagggat

SEQ ID NO: 353667 - DNA, 2319 bp, Homo sapiens
gttcttgataagaagaaaaacaacatccaagtccaaggctattactccaaagcgatcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaacacaacaaccaacaaaaaaaaaaaacaacaaaacaaaacaaaaaaaaaaaaaaaaaaacaaaaaaaaaaggggggggccaaaaaaattcccccgggggccccatttggcccccttttttgtcacaaagaggctccactataagagacctctccttaaaaaaagacagaacgtcctgccatcatattataaacaacgtcgctatcagaggaaaaaaactctacctactgtaacaatctttgggaaaaaagcaccccacatttttctaagagagacacaaaatggggagacacacccatcagaaagattaacacatcactcagtgaaaataccaacattaagagattatagtgtataaaccactgtgtatttactccgccagaaacttttgcaagacgaattatcgaaaatttaacagggat

SEQ ID NO: 353668 - DNA, 1573 bp, Homo sapiens
ctcgcggctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgttcaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctaccttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcagaacgtcaataataaggctgaaactcattaagcatacaactataaaccaaacatgatacgtactgtcataacact

SEQ ID NO: 353669 - DNA, 386 bp, Homo sapiens
gagtttgcccaaatcacctggggcattggagacaaaggaaaaccacttgaaaacagttccaacgggaagcacggctcatccttgtggccgtaaacgataaacaaacactataaatgggcaccacagacaaagccacatcagtgccagtttttatctttggggcctatctcctgttcatgtgcaaacctgtaggtcacagagacacctttgctgggacttgtgctgttttgggctacagggcagcctcttccagactgagctggggtccattgacagactcctccccgactgcaggagatactttgcctctccagtttggtgtctgagtgatcattcaacggtgcattattaatgtttgtttgtttatttatttatttttgatgaga

SEQ ID NO: 353670 - DNA, 3268 bp, Homo sapiens
tttttttgtaggacaggaatttttattccacgccaactcttccagagtcttgaagtcttcctgcagattgttaatgaacaattatagcaaaaaatgaatgaatgaattaacgaatgtataagtggatgaatgacgaatgaaccaacaatgaatgaatgtagagaaagcctcaagggggcccgagggtacgctgtgctgcggagcatgcccaccaggtggcgatgccagcggcgggcgggcctggccggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccaaaaaaaaaaatattgtg

SEQ ID NO: 353671 - DNA, 3214 bp, Homo sapiens
tttttttgtaggacaggaatttttattccacgccaactcttccagagtcttgaagtcttcctgcagattgttaatgaacaattatagcaaaaaatgaatgaatgaattaacgaatgtataagtggatgaatgacgaatgaaccaacaatgaatgaatgtagagaaagcctcaagggggcccgagggtacgctgtgctgcggagcatgcccaccaggtggcgatgccagcggcgggcgggcctggccggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccatggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccaaaaaaaaaaatattgtg

SEQ ID NO: 353672 - DNA, 2906 bp, Homo sapiens
tgacatgattagaatcgagctggtacccctagtgttagaagttcaatagcagtatattagttaacaggcaaactattgcacataaaccaaatctttgcttaagcaaaattttagatgtattgtaaatgtattaaatacggacttcaagtttagaagtggccccaagaattcccatattaagagcttgtttgaggtcaagtctttcaggagcactttgcctctaacattgtagaaataaatatatcttcccgatctttctttttttctgttacttcctcttgcaatcatttaattaaaatatctttattaagaattgccttgttttgatttaaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccaaaaaaaaaaatattgtg

SEQ ID NO: 353673 - DNA, 3075 bp, Homo sapiens
tttttttgtaggacaggaatttttattccacgccaactcttccagagtcttgaagtcttcctgcagattgttaatgaacaattatagcaaaaaatgaatgaatgaattaacgaatgtataagtggatgaatgacgaatgaaccaacaatgaatgaatgtagagaaagcctcaagggggcccgagggtacgctgtgctgcggagcatgcccaccaggtggcgatgccagcggcgggcgggcctggccggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccaaaaaaaaaaatattgtg

SEQ ID NO: 353674 - DNA, 2558 bp, Homo sapiens
tgccttcctggcaatttgcatgcaacacctgattgattgtgtgggcaacacataaaaggtggcaccagccgtcctatacacaacttaatttttaaatcagaaaacgcttcagtctctgataattcctcatattctcttgaagttcgggtaatggagtatggtaatgcagatgcagaaaagcagcagaggtcaggcatagtgtgtgccttgaattagctgccttttaaatattgtctctgtttgatgtttagttttttaactttaatgtcttcacttttcccctctatctttagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccaaaaaaaaaaatattgtg

SEQ ID NO: 353675 - DNA, 391 bp, Homo sapiens
ttatacaagaaaaacacctatgtggaaatgttggctacttatttacaggataatttcaaaaggttaggcattaatgtagaacaaatcagacgattaagacttaatagattctgaattgttgttttctgtcttggcattcaaatctggatggtgcatggtcctgtagcttttaaattgttatcataaagacatatgttttcaataatagaagtatattagttaacaggcaaactattgcacataaaccaaatctttgcttaagcaaaattttagatgtattgtaaatgtattaaatacggacttcaagtttagaagtggccccaagaattcccatattaagagcttgtttgaggtcaagtctttcaggagcactttgcctctaacattgtag

SEQ ID NO: 353676 - DNA, 3086 bp, Homo sapiens
tttttttgtaggacaggaatttttattccacgccaactcttccagagtcttgaagtcttcctgcagattgttaatgaacaattatagcaaaaaatgaatgaatgaattaacgaatgtataagtggatgaatgacgaatgaaccaacaatgaatgaatgtagagaaagcctcaagggggcccgagggtacgctgtgctgcggagcatgcccaccaggtggcgatgccagcggcgggcgggcctggccggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggtt

SEQ ID NO: 353677 - DNA, 3393 bp, Homo sapiens
tttttttgtaggacaggaatttttattccacgccaactcttccagagtcttgaagtcttcctgcagattgttaatgaacaattatagcaaaaaatgaatgaatgaattaacgaatgtataagtggatgaatgacgaatgaaccaacaatgaatgaatgtagagaaagcctcaagggggcccgagggtacgctgtgctgcggagcatgcccaccaggtggcgatgccagcggcgggcgggcctggccggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgaccaagaatcttgaaagccaaatgttctcattaagaagctgttagagtgcaataatgcattctaaatgcctgtcttagaagatatttcacaagttaatggattttttaagtttttcaaagatatatcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtcagtctttgttcaaacatctgtttgttctatctccagtcattaaatcagtgctgctgcatgacactcttaactcctgactttttatatccagtcataaagttgactttcagcacaaaagatacttataaacaaataaaaaatttttatttttctctcttactgatgtaagctttggcactcttttgactggtgccattagacatcttgattattgtgacaactctagacctgcctgctttatctaatgtaatcatgctcaatgtctacaggttgtttaataatcagtcacacagagaactgaggaactgatgctgtttgtttgcttctatgatacagagatgtctaaaaacttcaaatggacatgttttgtagtttagcgacttccgtatacataaagggacatattaatactggttcatttgtaaattattattcatatagaccactgtagtagataaaactctatggtacacctgcttatgtgttgcctcacactgtgtgtgattttgtttcttttgttaagcagcacttatgtagactgcatttccaaatgtgttgagcactcagagtgtagtcaacagtaagttcttttaatgaatatcagttttaatttatagactgccatggccttaaaaatattctgtacaatatactgcactgtgttgcacagacactacttgcttttctccattcatatttttatgagtagaatctgggcttttaaatttctcttcttattctttgaagcatgttgcatactaccctggtgggatggatggttctgtaaatgaagggatatttaaacttgctactgttgttcaacaccattaatggtcagtgtgaaccattacaaagaatgtggcaacttgcttgtgcctaaaaggaggaattggaactagaatgtgtgactctgtggggactgcataggtttgttaattgacctatagctaaaccttaatgtgtttgtgtgtctatacattgctttccgcatttcaagacatccagacgctattaccaacattttcctgtgcattaacctctgcatgtgaaaacttttaacagttactgaactatgtaaatatgtgaatttttttatttaggtggatgcattttttgtctgtttactgctcttctcagctttattcaataaacttgcattttaagggttgtattggcaattttaacttaaaatgtgcatcatgatggaaggtgcagacttttttggaagtttccgagaggagggtctatagaccatttgtcagaaatcagatcagccctcaaagaatggggtctgtgggctagttaaaatagaaataaacttttaaaatatccaaaaaaaaaaatattgtg

SEQ ID NO: 353678 - DNA, 1919 bp, Homo sapiens
tttttttgtaggacaggaatttttattccacgccaactcttccagagtcttgaagtcttcctgcagattgttaatgaacaattatagcaaaaaatgaatgaatgaattaacgaatgtataagtggatgaatgacgaatgaaccaacaatgaatgaatgtagagaaagcctcaagggggcccgagggtacgctgtgctgcggagcatgcccaccaggtggcgatgccagcggcgggcgggcctggccggattggccgcgccgctcttgccgtgggtgccgacggcggcgccgggacgggcgtggggggtagggcgagtcatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatcatgctggcgctcatctcccgcctgctggactggttccgttcgctcttctggaaggaagagatggagctgacgctcgtggggctgcagtactcgggcaagaccaccttcgtcaatgtcatcgcgtcaggtcaattcagtgaagatatgatacccacagtgggcttcaacatgaggaaggtaactaaaggtaacgtcacaataaagatctgggacataggaggacaaccccgatttcgaagcatgtgggagcggtattgcagaggagtcaatgctattgtttacatgatagatgctgcagatcgtgaaaagatagaagcttcccgaaatgagctacataatcttctagataaaccacagttacaaggaattccagtgctagtgcttggaaacaagagagatcttcctaatgccttggatgagaaacagctaattgaaaaaatgaatctgtctgctattcaggatagagaaatttgctgctattcaatttcttgcaaagaaaaggataatatagatatcacacttcagtggcttattcagcattcaaaatctagaagaagctgaagcatctcctgaagtcttccagtccttcttggctataatcctagaattattgtccgttcctctgaagtaattcccagaatacggtccttcctaaaccccagaaattgcctttttcagagtttatttctcatgtgcactgctgaagatgaatatccctaatccttcataaagaatcagctagagttgtcatgataaagtcagcacacacaaaaaggcttcttacacatacctgtcttaaaccatgtgtagagctttaaaaacagaaaaaaaaccccatatacttatgaccatcttaaatcaagaaaattgcatatttccattctggtctttctgggccagatttttatattggttttcagtaaatgtctatctataatatttcattatagagtccagtagcttaatactgacactgacttgatacagcatgaagtttctagtgccacacacagtatttagaaaacctttaggcgtgaatgactcatgtgggatatatgtaaacataatgtttattttatctcacaaatgcatgtgaaatgtataattacatcttaggaatccaaaatggtctgcagagagtgagcggaggcaccagatcaatgttggttctttgcactggtgagattctgcctgatgaatattaaagatatcctgctttctgagaactctatcaccagatggcagttgggatatgggaggaactaaagcatcctgttttgtatctgtccagatcattatttctgtctcttgttttttcttcctggttcaggatacttttttaaggggttgagaattgaagattttccaaaagcgttcatgaatttagagcattccacccaatataataaaacctgttaagaatgtca

SEQ ID NO: 353679 - DNA, 2185 bp, Homo sapiens
tgccacatgtgccccacgcctgcccccagcactctaggtggtggttagtgagctctgagaaatgaattctttgtggcttggagggcattcattttcacaatcctaggatgcccaccatttattgtgtgtgtgagcggggagtgggtcatgcatgtgtatcaagtgtgtgtttcttgtgtggcattgttgctcttgggtatgacaaatggttttgtaaatcacctacaatgtgaattcttagggattgattgtttggaaactctgtattttaaaaacttttcccccattttattttaggaaaacatcatatattttgatgttatattagcattcctgttgctgattttctgtcttgagggaaaaagttattcaggagagtatgttgatcttggttcataatccatctccattaatctaatttagttgttaaatataaaggtattttctatgtcatagttttagtcaacctaaatttttcctactttctttaagtgtggtcatcaggtcaaagggaaataggggttactctcgttcttttttcgcagaaaaactgcagcatataatctatgtttgcattggaatgtgatggtgctcactttgggcattatttgggaactgactttggctgctttttcttagggacacagcaggtcaggagagattcaacagcattacctcagcttattacagaagtgccaaggggatcatattagtatatgatatcactaagaaggagacatttgatgatttgccgaaatggatgaagatgattgataagtatgcttcagaagatgcagagcttctcttagttggaaataagttggactgtgaaacggacagagaaatcaccaggcagcagggggaaaagtttgcacagcagatcactgggatgcggttctgtgaagcaagtgccaaggataacttcaatgtggacgagatatttttgaaacttgtcgatgacattctgaaaaagatgcctctggatattttaaggaatgagttgtccaatagtatcctgtcgttacaaccagagcctgagataccgccagaactgcctccaccaagaccacatgtccgatgctgttgatttcctactttggagacaaagtggaaatgattcctggaaaggggaaaaaacgttctattctgcactacaatcattttgacaatttcctttcgcactttgtaatccaagtcagagctatacactaacttgtaaatatgcatatatgcaatcctgggtaagttttggttataagttacctatttccctccaaattattatatttcattcattaccccagtgtctagtgtacatacactgggaaacctagtacttctaatatgaagaatgggagaaatgaaaggtataatgtttcttgaaataaataatataattgtccttattaattatattatgaggacagaagatattctgataagagagaacgtggtgctttgcttaccgttttaaagaaaatttgtaaaactaaagactttttgaaaaaaagctatcttaagtgctttttctttatttacaagacatttcccccagtggtagcatctgaagtattggagtgtttctgccacgaagcaaagctccattcatggccgtcatggaaggttatttattaatgttacataatggtagaatattactagttagagggttggatttgacttggtcctaaggccacagaatctctctcatggcttcctaagggatgtacctttatgcttttaagaactacaaagattcaataaagaaagaaatgtttttgaaactatagaaaaagattttaaaacacgctgctgtcctaaacaaatcctgtttaaaggaattttaaagagatgcattttactatatcaaagaacatacgtgtatttgcctaaacactctgtacctttgtaatgataaaacttcccccttctttacggtgaagcttattctgattaagcctagactgtgttctttttttttttttttttttttttggtctgatgatgaatttgtgaactctttctttggtatatcttttattaaactgcactgttttgtttagtcaaggtaattaagtaattatgtatttgaataacttggtgtgtcttgagtgttgtggtatgaaaagcattgtggtctttctacactaatgaagtgcaaataaaattttgtatttatgaatga

SEQ ID NO: 353680 - DNA, 817 bp, Homo sapiens
  misc_feature (9)..(9): n is a, c, g, or t
cccctcgcntctaccttgtctgaagagttggaaatcaaacacacagttattctagtctaaatattctgtaaatttaaggctaccatttagtaaattttcattctttactttgtcagtttgttaaaatgaaacaaacctaagtttaaatttccttgttttttctgtctcggctctacatttcccccagtggtagcatctgaagtattggagtgtttctgccacgaagcaaagctccattcatggccgtcatggaaggttatttattaatgttacataatggtagaatattactagttagagggttggatttgacttggtcctaaggccacagaatctctctcatggcttcctaagggatgtacctttatgcttttaagaactacaaagattcaataaagaaagaaatgtttttgaaactatagaaaaagattttaaaacacgctgctgtcctaaacaaatcctgtttaaaggaattttaaagagatgcattttactatatcaaagaacatacgtgtatttgcctaaacactctgtacctttgtaatgataaaacttcccccttctttacggtgaagcttattctgattaagcctagactgtgttctttttttttttttttttttttttggtctgatgatgaatttgtgaactctttctttggtatatcttttattaaactgcactgttttgtttagtcaaggtaattaagtaattatgtatttgaataacttggtgtgtcttgagtgttgtggtatgaaaagcattgtggtctttctacactaatgaagtgcaaataaaattttgtatttatgaatga

SEQ ID NO: 353681 - DNA, 484 bp, Homo sapiens
taccagccagccccccaactctttgtggacccaccagctccttgggggaggaggcttccttcttgtcccctgtgtctcctgcaagctctgtccacttccgcactgcccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctga

SEQ ID NO: 353682 - DNA, 2622 bp, Homo sapiens
tgcttgaacctgggaggaggaggttgcagtgagccgagatcacaccactgcactccagcccgggtgacagagtgtgactccgtctcaaaaaaacccaaaaaaacaaaaaaaaccctaaaaattagccaggcgtggtggcccacatctgtaatcccagctactcgggaggctaaggcaggagaattgcttgaacccgggaggcagaggttgcagtgagcccagatcacacctctgcactcctggctgggtggcagagtgagactctgtctcaaaacaaaaacaaaaaaccaaagagtcttagaggagtagtgggatggagaagtgttatgagcagaaggctctgccgcagacagacagaagttgagaagggcagggtggtgacggtggagcttcaggaaccaggagcagggacttgtgggatccaagggaaggcatgggattggggcggggtggactaggctaaatgctgctggcagggcaggtccataagcgcaggtccttgaggcatccccaaggcactgcggctgtcccgcatgacctcccagggactctccttgcagctgcgccagggccccgcggggctggggcccaaaaagcgtgcggagcctcagctggtggagacccagaatgtgcggcttattgaggtggagcgcagtgtgagtgtgggcccacagtgggccctggggaggtgccccgtgcagtgtgagtgtgggtccacggtggaccctgggctggggggtatcccgtgcagtgtgagtgtggactcacagtgggcccgggggtgggggtgccccatgcagtgtgagtgtgggcctgtggtaggcactagggggtgcccccgccacctggctattgctaacccccacttctgggcagaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaaggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctga

SEQ ID NO: 353683 - DNA, 2136 bp, Homo sapiens
ttggaggaggctgagagggagcgccgggagaaggaggccctccaggcggagctggagaaagctgtggtgcggggcaaggagttgggggcccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaaggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctga

SEQ ID NO: 353684 - DNA, 1453 bp, Homo sapiens
tggcaggctggtactggtcggaggcttggttcagaaggcaagggatggaggcccccaggccttggacttggctcccccggcattagactcagtgctcgaggcatcagctgagtgtccccaggcacctgattcagacccacaggaggcagagagtccccttcaggcagctgccatggacccccaggcctcagactggtccccgcaagagtcaggctctcctgtggagacacaggagtccccggagaaggctggccgtagatcctctctccagagccctgcctctgtggccccacctcagggtccagggaccaaaattcaggccccgcagttgctgggaggagagacagagggaagagaggctccccaaggcgagttggtgcctgaggcctgggggttgagacaggagggccctgagcacaagccagggccttcggagcccagctctgtgcagctggaggagcaggagggcccaaaccagggcctggacctggccacgggacaagcagaggccagagagcatgaccagaggctggaagggacggtcagggacccagcctggcaaaaaccacagcagaagtcagaaggggctcttgaggtccaggtctgggaaggcccaatcccaggggagagcctggccagtggtgtcgcagagcaggaggccctcagggaggaggtggcacaggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctga

SEQ ID NO: 353685 - DNA, 2511 bp, Homo sapiens
tgcttgaacctgggaggaggaggttgcagtgagccgagatcacaccactgcactccagcccgggtgacagagtgtgactccgtctcaaaaaaacccaaaaaaacaaaaaaaaccctaaaaattagccaggcgtggtggcccacatctgtaatcccagctactcgggaggctaaggcaggagaattgcttgaacccgggaggcagaggttgcagtgagcccagatcacacctctgcactcctggctgggtggcagagtgagactctgtctcaaaacaaaaacaaaaaaccaaagagtcttagaggagtagtgggatggagaagtgttatgagcagaaggctctgccgcagacagacagaagttgagaagggcagggtggtgacggtggagcttcaggaaccaggagcagggacttgtgggatccaagggaaggcatgggattggggcggggtggactaggctaaatgctgctggcagggcaggtccataagcgcaggtccttgaggcatccccaaggcactgcggctgtcccgcatgacctcccagggactctccttgcagctgcgccagggccccgcggggctggggcccaaaaagcgtgcggagcctcagctggtggagacccagaatgtgcggcttattgaggtggagcgcagtgtgagtgtgggcccacagtgggccctggggaggtgccccgtgcagtgtgagtgtgggtccacggtggaccctgggctggggggtatcccgtgcagtgtgagtgtggactcacagtgggcccgggggtgggggtgccccatgcagtgtgagtgtgggcctgtggtaggcactagggggtgcccccgccacctggctattgctaacccccacttctgggcagaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaaggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatccggccatagggcctgatttcgagccgggcacggttccagcttttgttc

SEQ ID NO: 353686 - DNA, 226 bp, Homo sapiens
acaggaggtggccctgctggcagagcgtgaacgcctgatgcaagatgggcatcggcagcggggcctggaggaggagctgcggaggcttcagagcgagcacgacaggtgccgcccctgccacagcctctagcagctctcagtggccccatcctgaaagtgggttgggggtgtggggtcctgtctggcctcccctccccggcataacttctctggccagcactcggac

SEQ ID NO: 353687 - DNA, 314 bp, Homo sapiens
tgtagcatcggaatttctgcgagaaaaggaagctgcacagaggtaccagggcttggagcagcggctggaagctgagctgcaggcggcggcgaccagcaaggaggaggcgctgatggagctcaagaccagggccctgcagctggaagaggagctgttccaggtgatgcctgcccgcctgggagctgggggccatgccaccctgccctccatcccatgagcagatgccagggtcatctgtcctcctagtcttgcctctggattcttggctagctacttgcctcactccccatgtggggcctgttggagagagcact

SEQ ID NO: 353688 - DNA, 2310 bp, Homo sapiens
ctggcagcatcctggcgccccctgcccccccagcccccactgtcagctcctgacttcctgtccctccagccctccgtggccttttccctgtagccaaggtctctcacccgacccacctctgctgagcctctctagctgtctcgctgtcacatggctggggtggcagcccaccgggcgcatccacctttcactgcgcacatgaagaaccgtgggctcagagaggagctggagaaagctgtggtgcggggcaaggagttgggggcccggctggagcatttgcagcgtgagctggagcaggcggctctcgagcgccaggaatttctgcgagaaaaggaaagccagcaccagaggtaccagggcttggagcagcggctggaagctgagctgcaggcggcggcgaccagcaaggaggaggcgctgatggagctcaagaccagggccctgcagctggaagaggagctgttccagctgcgccagggccccgcggggctggggcccaaaaagcgtgcggagcctcagctggtggagacccagaatgtgcggcttattgaggtggagcgcagtaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaaggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctga

SEQ ID NO: 353689 - DNA, 994 bp, Homo sapiens
ctggtacggtccggaggtcctttggattggagcctgtgcccctgccccgtgacaagaagggcagctggctggcagacaaggtgaagaggctgatgcggccccggcgggaggggggcccccctggggggctgcgcctgggggccgatggggctggcagcaccgagagcctggggggccccccggagacggagcttcctgagggcagggaggcagatgggacagggtccccttccccggcacccatgcgccgggcccagagctccctctgcctgcgggatgagaccttggcaggcgggcagcggcggaaactcagctcaaggttcccggtggggcgaagctctgagtcattcagccctggggacacccctaggcaacgattccgacagcgccatccaggccccctgggggcgcccgtctcccacagcaaaggacctggtgtgggatgggagaactccgctgagaccctgcaggaacacgaaacagatgccaaccgagagggccctgaggtacaggaaccggagaaacgtcccctcaccccatccctcagccagtgacaccgtgggaacagcaggcttgggagtgcagccttctcggcactggagtgtcagcggaggccccaggcagcccaagagctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctga

SEQ ID NO: 353690 - DNA, 1873 bp, Homo sapiens
tgcttgaacctgggaggaggaggttgcagtgagccgagatcacaccactgcactccagcccgggtgacagagtgtgactccgtctcaaaaaaacccaaaaaaacaaaaaaaaccctaaaaattagccaggcgtggtggcccacatctgtaatcccagctactcgggaggctaaggcaggagaattgcttgaacccgggaggcagaggttgcagtgagcccagatcacacctctgcactcctggctgggtggcagagtgagactctgtctcaaaacaaaaacaaaaaaccaaagagtcttagaggagtagtgggatggagaagtgttatgagcagaaggctctgccgcagacagacagaagttgagaagggcagggtggtgacggtggagcttcaggaaccaggagcagggacttgtgggatccaagggaaggcatgggattggggcggggtggactaggctaaatgctgctggcagggcaggtccataagcgcaggtccttgaggcatccccaaggcactgcggctgtcccgcatgacctcccagggactctccttgcagctgcgccagggccccgcggggctggggcccaaaaagcgtgcggagcctcagctggtggagacccagaatgtgcggcttattgaggtggagcgcagtgtgagtgtgggcccacagtgggccctggggaggtgccccgtgcagtgtgagtgtgggtccacggtggaccctgggctggggggtatcccgtgcagtgtgagtgtggactcacagtgggcccgggggtgggggtgccccatgcagtgtgagtgtgggcctgtggtaggcactagggggtgcccccgccacctggctattgctaacccccacttctgggcagaatgcgatgctggtggcagagaaggcagctttgcaggggcagctgcagcacctggaggggcagctggggagcctgcagggccgtgcccaggagctgctgctgcagagccagcgggcgcaggagcacagcagccgcctgcaggccgagaagtctgtgctggagattcagggccaggagctgcaccggaagctggaggtgctggaggaggaggtgcgggcggcacggcagtcccaggaggagacccgcgggcagcagcaggccctgcttcgggaccacaaggccctggcacagctgcagcggcggcaggaggccgagctagagggactgctggtgcggcaccgagacctcaaggccaacatgcgggcactggagctggcccaccgggagctgcagggccggcacgagcagctgcaggcccagcgggccagcgtggaggcacaggaggtggccctgctggcagagcgtgaacgcctgatgcaagatgggcatcggcagcggggcctggaggaggagctgcggaggcttcagagcgagcacgacagggctcagatgctgctggcagagttgtctcgggagcggggtgagctgcagggtgaacgcggggagctacggggccggctggcgcggctggagctggagcgggcacagctggagatgcagagccagcagctgcgcgagtccaaccagcagctggacctgagcgcctgccggctgaccacgcagtgtgagctattgacacagctgcgaagtgcccaggaagaggagaaccggcagctgctggctgaagttcaggccctgagccgggagaacagggagctcctggagcgcagcctggagagtcgggaccacctgcaccgcgaacagcgggagtacctggaccagcttaatgccctgcgccgcgagaagcagaagctcgtggagaagatcatggaccaataccgcgtgctggagcctgtgcccctgccccggaccaagaagggcagcctggctgtcacct

SEQ ID NO: 353691 - DNA, 8469 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttgga

SEQ ID NO: 353692 - DNA, 1435 bp, Homo sapiens
gggaagggtgatcttcactccaacctgcttcttgggaccaggtgaggcttcgagctctgaggaagagcctccatccccagatgataaagagaaccaggccccaaaacggactggcccacatctgcgcttcgagatcagcagtgaggatgggttcagcgttgaggcagagagcttggagggtgagtggggggagtgcagtggcaggagggagagtgtccataaaacaccatcctgactcagctctggctctgctgtctccccaggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttgga

SEQ ID NO: 353693 - DNA, 586 bp, Homo sapiens
  misc_feature (549)..(549): n is a, c, g, or t
gagagagtttggtgtgcacctgggcctggatgcggctggggagaggctgcgcctagggagagcctttgccgtgccaggctagacagggacccatgcagactcagtgacagtggtgcctggcgcccagccccagccctggcttctcccctgagctgccctcccctacgcagcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggtgggccagaactgtggggtacacggttccttccccacctctcttcctgttcacttagggacccccgtggcccccaggcctggccctactgcctctcagtgtctcctcatctgttttcccagaggcctttaggccaagcccctgactgttcagacttcctggcaattctgtttacatgaaatggggagaaagtaccgaaatgggtccgccgcccccactncattcagttcctgacgctgtaactgtaatccttggtc

SEQ ID NO: 353694 - DNA, 8036 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtgcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttgga

SEQ ID NO: 353695 - DNA, 8523 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttggaaaaaaaaaaaccggggtttttggggggaaaggtaaatggaggcaggtcggaccg

SEQ ID NO: 353696 - DNA, 8431 bp, Homo sapiens
  misc_feature (8421)..(8421): n is a, c, g, or t
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttcgtcttctccccttctgtcgtcttctanggatcctgca

SEQ ID NO: 353697 - DNA, 344 bp, Homo sapiens
caaaagttagttgtatgtggtggcacgcatctgtggtctcagctgctcaggaggctgaggcaggaggatcgtctgagcctgggagttcaaggctgcggtgggctatgggtcacgccactgcattccagtctgggcaacagagcgagaccctgcctcaaaaaacaagaaaaagaatcgtcctggcgggtcttggttagttaaagaaggccctgggaatccaggtaacatttggggttgtagaagaagaggggcgtggaaggggagtgacctcactgctcattgtgtcctgcctagagctgccactgccagaacctgaggagcagagccggccccgcaaacctacc

SEQ ID NO: 353698 - DNA, 488 bp, Homo sapiens
gtttgggcccaagggctggccagggtgggtggaggcctgaaggtgagggcatccctgtgccagcaggtttcgccatctctgtctccacatccaacagcacctcctggagtgcgagcgctgccgccatgcataccacccggcctgtctggggcccagctatccaacccgggccacgcgcaaacggcgccactgggtgagagatgaggttcacccacttgctttgtctctaatgaatatcaccaccacccccaaacttgctctaggctggggctctcaggaggagcagaggttggggatcctcttaagaattgattagtaatgtttcctcttcaaaaatttcacataggtcagatttatattcagaatttgcatggagtggttttaggggcttatgaatctcacattccgtgggctcagaatcccctgctatagcctgatgtcctctcctgccctcatgttcctcctccgtgtctgtcctgcgtgttttc

SEQ ID NO: 353699 - DNA, 478 bp, Homo sapiens
cagtgggtgaagcgagcctgtccgcggggacagagcacctgatctccccacctcatccctgcagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcagg

SEQ ID NO: 353700 - DNA, 8307 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttgga

SEQ ID NO: 353701 - DNA, 7606 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccacccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttgga

SEQ ID NO: 353702 - DNA, 9104 bp, Homo sapiens
atggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggagtttcagggttttcattcagatgaagatgtggcccccagttccctgcgctctgcgctccgatcccagcgaggtcgagcgccccgaggtcggggtcgcaagcataagacgaccccccttcctcctcctcgcctagcagatgtggctcctacccccccaaagacccctgcccggaaacggggtgaggaaggcacagaacggatggtgcaggcactgactgaacttctccggcgggcccaggcaccccaagcaccccggagccgggcatgtgagccctccaccccccggcggtctcggggacggcccccaggacggccagcaggcccctgcaggaggaagcagcaagcagtagtggtggcagaagcagctgtgacaatccccaaacctgagcccccacctcctgtggttccagtgaaacatcagactggcagctggaaatgcaaggaggggcccggtccaggacctgggacccccaggcgtggaggacagtcaagccgtggaggccgtggaggcaggggccgcggccgaggtggtgggctcccctttgtgatcaagtttgtttcaagggccaaaaaagtaaagatgggacaattgtccttgggactcgaatcaggtcaaggtcaaggtcaacatgaggaaagttggcaggatgtcccccaaagaagagttggatctggacagggagggagcccttgctggaaaaagcaggaacagaagctggatgacgaggaagaagagaagaaagaagaagaagaaaaagacaaggagggagaagagaaggaagaaagagctgtagctgaggagatgatgccagctgcggaaaaggaagaggcaaagctgccaccaccgcctctgactcctccagccccttcacctcctccacccctcccacccccttcgacatctcctccacccccactctgccctccaccaccacccccagtgtccccaccacctctaccatcccctccaccgcctcctgcccaagaggagcaggaggaatcccctcctcctgtggtcccagctacgtgctccaggaagaggggccggcctcccctgactcccagccagcgggcggagcgggaagctgctcgggcagggccagagggcacctctcctcccactccaacccccagcaccgccacgggaggccctccggaagacagtcccaccgtggcccccaaaagcaccaccttcctgaagaatatccggcagtttattatgcctgtggtgagtgcccgctcctcccgtgtcatcaagacaccccggcgatttatggatgaagacccccccaaacccccaaaggtggaggtctcacctgtcctgcgacctcccattaccacctccccacctgttccccaggagccagcaccagtcccctctccaccacgtgccccaactcctccatctaccccagttccactccctgagaagagacggtccatcctaagggaacccacatttcgctggacctcactgacccgggagctgccccctcctcccccagcccctccacctcccccggccccctccccaccccctgctcctgccacctcctcccggaggcccctactccttcgggcccctcagtttaccccaagcgaagcccacctgaagatctacgaatcggtgcttactcctcctcctcttggggctcctgaagcccctgagccagagcctcctcctgccgatgactctccagctgagcctgagcctcgggcagtgggccgcaccaaccacctcagcctgcctcgattcgcccctgtggtcaccactcctgttaaggccgaggtgtcccctcacggggctccagctctgagcaacgggccacagacacaggctcagctactgcagcccctgcaggccttgcaaacccagctcctgccccaggcactaccgccaccacagccacagctgcagccaccgccgtcaccacagcagatgcctcccctggaaaaagcccggattgcgggcgtgggttccttgccgctgtctggggtagaggagaagatgttcagcctcctcaagagagccaaagtgcagctattcaagatcgatcagcagcagcagcagaaggtggcagcttccatgccgctgagccctggagggcagatggaggaggtggccggggctgtcaagcagatctccgacagaggccctgtccggtctgaagatgagtcggtggaagctaagagagagcggccctcaggtcccgagtcccctgtgcaaggtccccgcatcaaacatgtctgccgtcatgctgctgtggccctgggtcaggcccgggccatggtgcctgaagatgtccctcgcctcagtgccctccctctccgggatcggcaggacctcgccacagaggatacatcatcggcgtccgagactgagagtgtcccgtcacggtcccggcggggaaaggtggaggcagcaggccctgggggagaatcagagcccacaggttctggagggaccctggcccacacaccccggcgctcactgccctcccatcacggcaagaagatgcgcatggctcgatgtggacactgtcggggctgcctacgtgtgcaggactgtgggtcctgtgtcaactgcctagacaagcccaagtttgggggccctaacaccaagaagcagtgctgtgtataccggaagtgtgacaaaatagaggctcggaagatggaacgactggctaaaaaaggccggacgatagtgaagacgctgttgccctgggattccgatgaatctcctgaggcctcccctggtcctccaggcccacgccggggggcgggagctggggggccccgggaggaggtggtggcccacccagggcccgaggagcaggactccctcctgcagcgcaagtcagctcggcgctgcgtcaaacagcgaccctcctatgatatcttcgaggattcggatgactcggagcccgggggcccccctgctcctcggcgtcggaccccccgagaaaatgagctgccactgccagaacctgaggagcagagccggccccgcaaacctaccctgcagcctgtgttgcagctcaaggcccgaaggcgcctggacaaggatgctttggcccctggcccctttgcttcttttcccaatggctggactggaaagcagaagtctcccgatggtgtgcaccgcgtccgtgtggattttaaggaggattgtgatttagagaacgtgtggctgatggggggcctgagtgtgctcacctctgtgccagggggccccccgatggtgtgcttgctgtgtgccagcaaaggactccacgagctggtgttctgtcaagtctgctgtgacccattccacccattctgcctggaggaggccgagcggcccctgccccagcatcacgacacctggtgctgccgtcgctgcaaattctgccacgtctgtggacgcaaaggtcgtggatccaagcacctcctggagtgcgagcgctgccgccatgcataccacccggcctgtctggggcccagctatccaacccgggccacgcgcaaacggcgccactggatctgttcagcctgtgtgcgctgtaagagctgtggggcaactccaggcaagaactgggacgtcgagtggtctggagattacagcctctgccccaggtgcacccagctatatgagaaaggaaactactgcccgatctgtacacgctgctatgaagacaacgactatgagagcaagatgatgcagtgcgcacagtgcgatcactgggtgcatgccaagtgcgaggggctctcagatgaagactacgagatcctttcaggactgccagactcggtgctgtacacctgcggaccgtgtgctggggcagcgcagccccgctggcgagaggccctgagcggggccctccaggggggcctgcgccaggtgctccagggcctgctgagctccaaggtggtgggcccactgctgctctgcacccagtgtgggccagatgggaagcaactgcacccaggaccctgcggcctgcaagctgtgagtcagcgcttcgaggatggccactacaagtctgtgcacagcttcatggaggacatggtgggcatcctcatgcggcactcggaggagggagagaccccggaccgccgggctggaggccagatgaaggggctcctgctgaagctgctagaatctgcgttcggctggttcgacgcccacgaccccaagtactggcgacggagtacccggctgccaaacggagtccttcccaatgcggtgttgcccccatccctggatcatgtctatgcgcagtggagacagcaggaaccagagaccccagaatcagggcagcctccaggggatccctcagcagcattccagggcaaggatccggctgccttctcacacctggaggacccccgtcagtgtgcactctgcctcaaatacggggatgcagactccaaggaggcggggcggctcttgtacatcgggcagaacgagtggacacacgtcaactgtgccatctggtcggcggaagtcttcgaggagaacgacggctccctcaagaatgtgcatgctgctgtggcccgagggaggcagatgcgctgcgagctctgcctgaagcctggcgccacggtgggctgctgcctgtcctcctgcctcagcaacttccacttcatgtgtgcccgggccagctactgcatcttccaggatgacaagaaagtcttctgccagaaacacactgatctcctggatggcaaggaaattgtgaaccccgatggttttgatgttctccgccgagtctatgtggacttcgagggcatcaacttcaagcggaagttcttgacggggcttgaacccgatgccatcaacgtgctcattggttccatccgcattgactccctgggtactctgtctgatctctcggactgcgagggacggctcttccccattggctaccagtgctcccgtctgtactggagcacagtggatgctcggaggcgctgctggtatcggtgccgaattctggagtatcggccatgggggccgagggaagagccagctcacctggaggctgcagaggagaaccagaccattgtgcacagccccgccccttcctcagagcccccaggtggtgaggaccccccactggacacagatgttcttgtccctggagctcctgagcgccactcgcccattcagaacctggaccctccactgcggccagattcaggcagcgcccctcctccagccccccgttctttttcgggggctcgaatcaaagtgcccaactactcgccatcccggaggcccttggggggtgtctcctttggccccctgccctcccctggaagtccatcttcactgacccaccacatccccacagtgggagacccggacttcccagctccccccagacgttcccgtcgtcccagccctttggctcccaggccgcctccatcacggtgggcctcccctcctctaaaaacctcccctcagctcagggtgccccctcctacctcagtcgtcacagccctcacacctacctcaggggagctggctccccctggcccggccccatctccaccaccccctgaagacctgggcccagacttcgaggacatggaggtggtgtcaggactgagtgctgctgacctggacttcgcggccagcctgctggggactgagcccttccaggaagagattgtagccgctggggccatggggagcagccacgggggcccgggggacagctccgaggaggagtccagccccacctcccgctacatccacttccctgtgactgtggtgtccgcccctggtctggcccccagcgctacccctggagccccccgcattgaacagctggacggcgtggacgacggcactgacagtgaggctgaggcggtgcagcagcctcggggccagggcacgcctccttcggggccaggagtagtccgggcaggggtccttggggctgcaggggacagggcccggcctcctgaggacctgccatcggaaattgtggattttgtgttgaagaacctagggggtcctggggatggaggtgctggccctagagaggagtcactccccccggcgcctcccctggctaatggcagccagccctcccaaggcctgaccgccagcccagctgaccccacccgcacatttgcctggctcccaggggccccaggggtccgggtgttaagccttggccctgcccctgagccccccaaacccgccacatccaaaatcatacttgtcaacaagctggggcaagtatttgtgaagatggctggggagggtgaacctgtcccacccccagtgaagcagccacctttgccccccaccatttcccccacggctcccacctcctggactctgcccccaggccccctcctcggcgtgctgcccgtggtcggagtggtccgccctgccccgcccccgccaccccctcccctgacgctggtgctgagcagtgggccagccagcccgccccgccaggccatccgcgtcaagagggtgtccactttctccggccggtccccgccagcacctcccccatacaaagccccccggctggatgaagatggagaggcctcagaggatacccctcaggttccagggcttggcagtggcgggtttagccgtgtgaggatgaaaacccccacagtgcgtggggtccttgacctggatcggcctggggagcccgctggggaagaaagtcctgggcccctccaggaacggtcccctttgctgccacttccggaagatggtcctccccaggtccccgatggtcccccagacctgctgcttgagtcccagtggcaccactattcaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttggagaggtggtcttcccatttgtaggctgtgggggcaggtaggaaccccacttctacacacccacccatcatgacccaaggaagttcatcagcctcaacaggtaggtgaggccatcattcagaattagaagtcagtcatggggtctgttacggcttcagaacaacacaacacagcaactgtctgtagcagggttgtttcccagaggggattctggtggcccagaggcacctggggtcagccctcccacatgtggccctgtgtgtatgttggaataggcccttctagggcgaagagcagtgaggctatctgttgggtctttgcccaattaggattgtacttcaagaagtacttcagtgctaattgtatactgggcttagtagtcagcaaagttctttattgggtgttaagcccagcaaaccccagatgagccaagcttggacagcacccgcaatgcatctgcccgccctagctgggcgaggtgtgtgccaagctggcccagggaggcagagggctcccttgccaccaccatctcaatcagagcccgcagcggcgagcgactcggcctcagcgaataggcaaaggtggaccaggcagcaggcagcccatatcttgcggccaggtgtcgagtagtgccatg

SEQ ID NO: 353703 - DNA, 1351 bp, Homo sapiens
gggaagggtgatcttcactccaacctgcttcttgggaccaggtgaggcttcgagctctgaggaagagcctccatccccagatgataaagagaaccaggccccaaaacggactggcccacatctgcgcttcgagatcagcagtgaggatgggttcagcgttgaggcagagagcttggagggggcgtggagaactctgatcgagaaagtgcaagaggcccgagggcatgcccgactcagacatctctcctttagtggaatgagtggggcgagactcctgggcatccaccatgatgctgtcatcttcctggccgagcagctccccggagcccagcgttgccagcactataagttccgttaccaccagcagggagagggccaggaggagccgcccctgaatccccatggggctgctcgggcagaggtctatctccggaagtgcacctttgacatgttcaacttcctggcctcccagcaccgggtgctccctgagggggccacctgtgatgaggaagaggatgaggtgcagctcaggtcaaccagacgtgccaccagcctggagctgcccatggccatgcgttttcgtcaccttaagaagacgtccaaagaagctgtgggtgtctacagatcagccatccacgggcgaggcctgttctgtaagcgcaacatcgacgcgggggagatggtcatcgagtactctggcattgtcatccgctcggtgttgactgacaagcgggagaagttctacgatgggaagggcatcgggtgctatatgttccgcatggatgactttgatgtagtggacgccacgatgcatggcaatgccgcccgcttcatcaaccactcctgtgagcccaactgcttctctcgggtcatccacgtggagggccagaaacacattgttatcttcgccctgcgccgcatcctgcgtggtgaggagctcacctacgactacaagttccccatcgaggatgccagcaacaagctgccctgcaactgtggcgccaagcgctgccgtcggttccttaactgaggccgtggctgcccaccacgacccctcacacctcctgctgccgtcgctgccatcttgcccctagcctgggggctccctagcccctcccagagcatctcacccccaccctcatgttcagggtggatgtgggcatgcaggtgacaagggccctgcctccacccctccagcccatccagcaatcgccccctttctgccctgggggcccaggatgtagatattgtacaaaggtttctaaatcccttcttttctatgcacttttttatttaagaggtggggtcccaggtgggaacccccccacaataaagtctgtcaatgtttgga

SEQ ID NO: 353704 - DNA, 386 bp, Homo sapiens
atcagtttagttttcgacaaatttgataagagtatcagacatcgatatagtggtgtcaagtaggcagttgtgtatctataaaggcttagtgtatgcacatcttaattgtgtatcgtaaaacagttctccaaactggttgtacctatttacatttcatgttgcagtcacaacacgtgtattgtcaggattttttcattttgatgatctgatggtattatctggtatctcattgctgactatattctttaacaacaacgatactcctgggctaagccatctggatcttcactttacaagcactgaatattcataaactattggctagtggtgctgttgctacattttccgaaaccaaatcagccaaaagatgggagataccatatttt

SEQ ID NO: 353705 - DNA, 297 bp, Homo sapiens
ggaaatggatttgctagactcatcatattttcagtcttagcatcaagaaatgagtgattatttgcaatgaagttggcaagacaggaaactgagttaaaatttatcaatcgtttatttctaggtaaaacttttttttaagggagaaaactccctctagtattttatccctttttgtaatactgtatttttactgttcaccttgaatcttcagatttcttagaaataagatggatttttaaaaatgcagccgggccaagtgtggtggctcatgcctataatcccagcattttggggggc

SEQ ID NO: 353706 - DNA, 489 bp, Homo sapiens
atcattatgcagtgtcaactaggttaatgtggttgccactcagttatcctccatagtaaaattaatgacatttattctttctgtgatttctcaatgtacttgaccagtggttcctaaagagaagtgtttatgtatcttgtcccaatttgtcctttcttggccatactgtatttatttttatctgtctacacttaaagatctaaatttgcagccgggcgcagtggctcacgcctgtaatcccagcagtttgggaggccgaaggcgggcggatcacctgaggtcgggagttggagaccagcctgacaaacatggagaaacccgtctcttctaaaaatacaaaattagccgggcgtggtggcgcatgcctgtaaccccacctacttgggaggctgaggcaggagaatcgcttgaacccgggagatggaggttgcagtgagttgagatcacaccattgcactccagcctgggcaacaggagcgaactccttct

SEQ ID NO: 353707 - DNA, 332 bp, Homo sapiens
gacttgcatgttaatgtttagattatacctagaaacttgcaaatttccttgatcaatcagtttttttgacaggattgcattcttgagaaactaaatgacaagtagtaagttctgactttatagttcactaattattttggttaataagttagtagtaatttttaactttggtgtttttttgttttttttttttgctaatatcacaatgtaatacaactgttagtttcatgtcttctgctttcagttttatcctgtataatacttagaaatcttagtttccttttcattatccaagataaatttttagttggtaaattttcttggacgtgtcc

SEQ ID NO: 353708 - DNA, 339 bp, Homo sapiens
ctcctctgacatgcgacgtacacccctaatgcaacacatccgaaactgagctctgggtctccttccaaaagacacttgcttctgccactgaagctctgagtgtggttaattccatcacttctatcttcaccagaaaggtccacctcccctttcattctcctcttcctcctcctgaatagcttgtaagtcaccaagtgatgttgagtgtttctctcagatgcttctggaaccatttccatcgttggcatcccactgccaagcaacttttgcatgggaacgtcttactgggctatggcagcagcagctgaactggttttcctaccacacctttccctagta

SEQ ID NO: 353709 - DNA, 473 bp, Homo sapiens
tgttaaggatatgaaagtaaaggaaagactgaggaactgtttcagactaaaggcgactaaggaaagatgacaaataattgcaatgtgtggttctgaactggaatcctttgctataaattatacattattgagcaatggagaaacttgactggggtatgaagattagatcgcaatgtatcaatgttaattttccaattttgctgtttgtactgcagttatgtaggggaatgtctctgttgaagaaatactaagatatttggggatgatggggaaatcaaattgacatcttcctttcaaatggttcaggggaaaagaaggtctttgtactttacttgcaacttttctgaaaaattgagattgtctcaaaatgtactttttttaaagtttaataagaagggagtatcattacgagaactgtagtatagtcacatgaataaactttatgcagacattaaaaatgtttttggaaaata

SEQ ID NO: 353710 - DNA, 838 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttact

SEQ ID NO: 353711 - DNA, 1632 bp, Homo sapiens
aatattctgcttttcctgttatgtgtttcagatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagcataggcctgtgccctgggaatggcaccacaaaggaagagaaggaaacagctgagcatgaaaacagggagctacagtcaaaggagttcctttcagcgaaggaagagacccaggggcagggcagaagcaggaactccgctccttctggagctacgctttctctcggcgctttgcctggcacctggtgtggctgtctgtgatacagttgtggcactacctcttcattggcactctcaactccttgctgccaacatggccggtgggacatggcacgagtcagcacctacacaaatgcctttgccttcactcagttcggagtgctgtgtgccccctggaatggcctgctcatggaccggcttaaacagaagtaccagaaggaagcaagaaagacagggtcttttaacatccgaggaccacattctttatactttccaaatcatcacctgccccatgcaacttacagggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttact

SEQ ID NO: 353712 - DNA, 845 bp, Homo sapiens
aaaactaccaactcacccacgtgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttact

SEQ ID NO: 353713 - DNA, 774 bp, Homo sapiens
tgtgagaggaagcaaagaaggacctgggctttgggaagatctaaagacccaggaaggtctctgggtgggataaagccaagatgaaactccccctacttctggctcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttact

SEQ ID NO: 353714 - DNA, 495 bp, Homo sapiens
gccatcccagttgcatctcttccgtggatacttttgttgatgccaggggcctgggggagcgggctggttgttcccacacatgggtgtgtggatgggccctgcacatgcgccttatgactggttgtgggtagcaagcacagaatgatcctgtttttctgccaaggaacccccggcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcacttcgctccgcccggcaccgtcagctcctttgtggccaagcttttcatctttgtgtctgcaaggaacccacg

SEQ ID NO: 353715 - DNA, 1176 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcagaaaaggtgccagggggtccagtgacctggaagtcaggatgaactccccccaaacaaggtgcaggtgggggctggtaagagctggtccaaaaggaagttgggaaactattccgctggcttgagagagctgagctgtctgtatcgaatcccaggctgtgccgtatgtctactgttccttgtggggctcagcccaatgatggggtagcagaggtgactgtagttggttctgtctttgtgatgtcacactggggagcaggaatcctggccgcatgcactgaaggcatcagcagaggcccataggatggtcccgggcagagccgcaggagggtgtgatggt

SEQ ID NO: 353716 - DNA, 896 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcacttcgctccgcccggcaccgtcagctcctttgtggccaagcttttcatctttgtgtctgcaaggaacccacg

SEQ ID NO: 353717 - DNA, 1555 bp, Homo sapiens
tgtgagaggaagcaaagaaggacctgggctttgggaagatctaaagacccaggaaggtctctgggtgggtgagtgctttctctgctgtggtggagctggtgacagtttattctcccaggaggtccctggctgtggctgacagtttctggagggctggcaggcgtctacctgtggctttcaggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353718 - DNA, 1374 bp, Homo sapiens
aaaactaccaactcacccacgtgggaagatctaaagacccaggaaggtctctgggtgggataaagccaagatgaaactccccctacttctggctcccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353719 - DNA, 1425 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353720 - DNA, 1293 bp, Homo sapiens
tgtgagaggaagcaaagaaggacctgggctttgggaagatctaaagacccaggaaggtctctgggtgggataaagccaagatgaaactccccctacttctggctcgagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353721 - DNA, 1151 bp, Homo sapiens
gagttgagtggcgcgcccatcctggcgcctgtgcagtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353722 - DNA, 1388 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagttcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353723 - DNA, 1352 bp, Homo sapiens
tgtccgtagcagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaggggtggtgagaacgggagaaccccaggacgccctcactgcaggctcccctcccgggcttccttcctctctgcaaggaacccacgcgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353724 - DNA, 1041 bp, Homo sapiens
gccatcccagttgcatctcttccgtggatacttttgttgatgccaggggcctgggggagcgggctggttgttcccacacatgggtgtgtggatgggccctgcacatgcgccttatgactggttgtgggtagcaagcacagaatgatcctgtttttctgccaaggaacccccggcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353725 - DNA, 1086 bp, Homo sapiens
tgtccgtagcagactccacaacaccccagcttcctcttccaggacaagagggtgtcctggtccctggtctacctccccaccatccagagctgctggaactacggcttctcctgctcctcggacgagctccctgtcctgggcctcaccaagtctggcggctcagatcgcaccattgcctacgaaaacaaagccctgatgctctgcgaagggctcttcgtggcagacgtcaccgatttcgagggctggaaggctgcgattcccagtgccctggacaccaacagctcgaagagcacctcctccttcccctgcccggcagggcacttcaacggcttccgcacggtcatccgccccttctacctgaccaactcctcaggtgtggactagacggcgtggcccaggggtggtgagaacgggagaaccccaggacgccctcactgcaggctcccctcccgggcttccttcctctctgcaaggaacccacgcgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgcgtgggttccttgcagaaaaggtgccagggggtccagtgacctggaagtcaggatgaactccccccaaacaaggtgcaggtgggggctggtaagagctggtccaaaaggaagttgggaaactattccgctggcttgagagagctgagctgtctgtatcgaatcccaggctgtgccgtatgtctactgttccttgtggggctcagcccaatgatggggtagcagaggtgactgtagttggttctgtctttgtgatgtcacactggggagcaggaatcctggccgcatgcactgaaggcatcagcagaggcccataggatggtcccgggcagagccgcaggagggtgtgatggt

SEQ ID NO: 353726 - DNA, 482 bp, Homo sapiens
tgaattcatgtaggaaggatgctccattctttgtcttttatcctgccctgtagtttacttgccggaggtgctacaggggcaacctggtttccatccacaacttcaatattaattatcgaatccagtgttctgtcagcgcgctcaaccagggtcaagtctggattggaggcaggatcacaggctcggtaagagaagtgtgaacactaaatggggtgcacctgctgatctcagccagcactcagcttgcatcagatttgtctgtttttctcctgtataatctccagaagaaccagggatagatggacacccacagacaacactgagggggctgcctgggcattcagggaagagctaaggatttagaatcaggaggtttgggtccaagttcctttccatctctcactatctatgtaacttaagttagctgggcatggtggtgcatgtctgtaatcctagctacttgggaggctgaggcaggagag

SEQ ID NO: 353727 - DNA, 1442 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353728 - DNA, 855 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttact

SEQ ID NO: 353729 - DNA, 818 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgagagggtactggggtggccccctcgctcaaaaactccttttattggcctaccgagcggggccagccacaatttggcccttcctgggaggggccccccccttggttggcatccccctccacccctgcaggg

SEQ ID NO: 353730 - DNA, 300 bp, Homo sapiens
gggctgtgctgaggtgactctgaggatcccgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 353731 - DNA, 1283 bp, Homo sapiens
  misc_feature (962)..(962): n is a, c, g, or t
  misc_feature (979)..(979): n is a, c, g, or t
  misc_feature (984)..(984): n is a, c, g, or t
  misc_feature (987)..(987): n is a, c, g, or t
  misc_feature (999)..(999): n is a, c, g, or t
  misc_feature (1014)..(1014): n is a, c, g, or t
  misc_feature (1022)..(1022): n is a, c, g, or t
  misc_feature (1033)..(1033): n is a, c, g, or t
  misc_feature (1037)..(1037): n is a, c, g, or t
  misc_feature (1044)..(1044): n is a, c, g, or t
  misc_feature (1054)..(1055): n is a, c, g, or t
  misc_feature (1060)..(1060): n is a, c, g, or t
  misc_feature (1066)..(1066): n is a, c, g, or t
  misc_feature (1075)..(1075): n is a, c, g, or t
  misc_feature (1081)..(1081): n is a, c, g, or t
  misc_feature (1083)..(1084): n is a, c, g, or t
  misc_feature (1095)..(1095): n is a, c, g, or t
  misc_feature (1102)..(1102): n is a, c, g, or t
  misc_feature (1105)..(1105): n is a, c, g, or t
  misc_feature (1112)..(1112): n is a, c, g, or t
  misc_feature (1114)..(1114): n is a, c, g, or t
  misc_feature (1121)..(1121): n is a, c, g, or t
  misc_feature (1123)..(1124): n is a, c, g, or t
  misc_feature (1128)..(1129): n is a, c, g, or t
  misc_feature (1135)..(1135): n is a, c, g, or t
  misc_feature (1137)..(1138): n is a, c, g, or t
  misc_feature (1145)..(1145): n is a, c, g, or t
  misc_feature (1150)..(1151): n is a, c, g, or t
  misc_feature (1158)..(1158): n is a, c, g, or t
  misc_feature (1160)..(1160): n is a, c, g, or t
  misc_feature (1174)..(1174): n is a, c, g, or t
  misc_feature (1179)..(1179): n is a, c, g, or t
  misc_feature (1191)..(1191): n is a, c, g, or t
  misc_feature (1194)..(1194): n is a, c, g, or t
  misc_feature (1197)..(1197): n is a, c, g, or t
  misc_feature (1202)..(1203): n is a, c, g, or t
  misc_feature (1205)..(1205): n is a, c, g, or t
  misc_feature (1212)..(1212): n is a, c, g, or t
  misc_feature (1235)..(1236): n is a, c, g, or t
  misc_feature (1250)..(1250): n is a, c, g, or t
  misc_feature (1270)..(1270): n is a, c, g, or t
  misc_feature (1272)..(1272): n is a, c, g, or t
  misc_feature (1280)..(1280): n is a, c, g, or t
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactaaaaaaaaaaaaaaaaaaaaaaaaaaaaaaaaaaaaaaaaaaaaaaaaaaaaaaaaaaaaaaaaaaaaaaaaaaaaaaaaaaaaaaaacccttgtgggccgcttggnccaagtcaattttaaantgganaangtttatgcttgnggccgaatttggggntaattggnccaattccccntatngggagcngtttaaaatnnatggnccgggntttaacaangtgggnannggaaaaccctnggggtanccnaattaantngcttggnannaaanncccttntnncaagtgnggtannaggaaangncccgaccgacgccnttccnaaagttgccccnctnaanggcanngnaaattgnaaccctaatatttgtaaaaatcnnggtaaattttggtnaacaagctatttttaaccananggccaatnggg

SEQ ID NO: 353732 - DNA, 843 bp, Homo sapiens
tgtgagaggaagcaaagaaggacctgggctttgggaagatctaaagacccaggaaggtctctgggtgggataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcaaggaacccacgcgggatccttagatagaaaca

SEQ ID NO: 353733 - DNA, 1421 bp, Homo sapiens
ccatcttcaccctcatcaaaggctcccttcagaatgacccattttacgataaagccaagatgaaactccccctacttctggctcttctatttggggcagtttctgctcttcatctaaggtctgagacttccacctttgagacccctttgggtgctaagacgctgcctgaggatgaggagacaccagagcaggagatggaggagaccccttgcagggagctggaggaagaggaggagtggggctctggaagtgaagatgcctccaagaaagatggggctgttgagtctatctcagtgccagatatggtggacaaaaaccttacgtgtcctgaggaagaggacacagtaaaagtggtgggcatccctgggtgccagacctgccgctacctcctggtgagaagtcttcagacgtttagtcaagcttggtttacttgccggaggtgctacaggggcaacctggtttccatccacaacttcaatattaattatcgaatccagtgttctgtcagcgcgctcaaccagggtcaagtctggattggaggcaggatcacaggctcgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353734 - DNA, 1034 bp, Homo sapiens
cgtatgagaggtgaaggtcatgagggtggagcccacatgaattggattggtgcctctgtaagaaggggtaccagacggctttttagctctctttctgctatgtgagaatacagcaaaagttggcaaagacccttgccagaacctgtctctgcaaggaacccacgcgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353735 - DNA, 1058 bp, Homo sapiens
ccctaaggcgcctcatgttacagtgagtctgcacacctaccacatttttttcccataggccttcaccaactgcatagggcccaaacactaaagccaggcagccctggaagaaatgcactgtagtggccctcctaaggctagagataggacaacagggtggagaatgatctctctgcaaggaacccacgcgcgtgggtcgctgcagacgctttcagtgggttgacggcagccgctggaactttgcgtactgggctgctcaccagccctggtcccgcggtggtcactgcgtggccctgtgtacccgaggaggctactggcgtcgagcccactgcctcagaagacttcctttcatctgttcctactgagctggtcccagccagcagttcagagctgccctctcctgggcagctgcctcccctcctctgcttgccatccctccctccacctccctgcaataaaatgggttttactgaaatggatttattttctcctctgatcgcggatccactctgcttagccctcattgaaacttcttccttatcatctctccccacaccacaactttcatagaagtgtcagaagctactactccttgaggaggaggatggagggtggagttgggtctatggagccttttggagatggaggaatgggctcagctagttctcttcatagaacacctgattactgggcacctgcatagtgctgccaggacctttcaaggttgtaggtagactcccaatggcccagtttgcatctctgtaaccaaaggccttttctctgtctctctccaaccccagaactgtggttggttttatatgtaaggaagttaacatgtccctgggaacagtccacaacattcaggaatgaatgtataagtaccgcaatccccggcccctcaagtggaataaatctaacatgtattgggcaccatttcccagtggcctgctgtggtagttggccttattccatgcatttttatgggctgccttcccttcctcaactgcattctctgctccttcctactctctgcaactcccaaataaacacttgtacgc

SEQ ID NO: 353736 - DNA, 633 bp, Homo sapiens
actcaatgtctgggctccaaaccatgcataatatccacaactaaaatggccatgtcaccaagagagcttcctctatttctcagattactggaagattcatgcccaggagtatccataatttagcattcctgggatccggacattctctctatcccaatttttaatcatctgagtctgtattaactgcttgccagcagttaatacagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctgtattaactgcttggggatccttagagtcgagccagca

SEQ ID NO: 353737 - DNA, 636 bp, Homo sapiens
  misc_feature (50)..(51): n is a, c, g, or t
  misc_feature (56)..(57): n is a, c, g, or t
  misc_feature (63)..(63): n is a, c, g, or t
  misc_feature (80)..(80): n is a, c, g, or t
  misc_feature (114)..(114): n is a, c, g, or t
  misc_feature (144)..(144): n is a, c, g, or t
  misc_feature (146)..(146): n is a, c, g, or t
  misc_feature (188)..(188): n is a, c, g, or t
atggataagtttatactagtgttggcacatggcggcatgtatagatatannaggannacctanttgtattccttgtatgnaaaagcgtccctggtactacaataagtctttcgngaaaggagtgtaatcctaacaacaactcangnaagtattttgaaaagaatacttggataaggaaaaacctgcanctactcctgctatttcaagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaagtgagtatggaaactcgggttggtatagacatgctagctagtttccatttatgccataaattacagagaccccctgaaattcggcagactctgtcttccagaatttctctaacattaggtaattgaacgtattggccattatgaatcattgtgtcccttagagcatgtggaattgatagcctgcaacgtgtaactttgcatttggaataaggaaggagtgaaggccatatggggagtaatattctacaggaatgtcagcactgtgaagacagggactc

SEQ ID NO: 353738 - DNA, 703 bp, Homo sapiens
caagcagggcatgagttcaccaccccagtaacaacagtgcattacaatacttaataatggaacaaggagagtagtattttagtctcaaaagcattggcacttacaacctattgctttgtttttagtggtttccagctgtggttgcattgcacgtagaaagtggaataatgtaatgggctttgaaaccataataatgaatgtctgaataatgacattatttcttgcgtttgtaatactgttaattaaatctatgtcgatcctgttggaattcataaaatcatctaaaaatttttctaaatatacagtgttgttttccccattgtatcttgatctcaagcaacaaatggtaaaagtatagctattaatgtcattaaatgtgaattgtttcaacattatgaagggttcctcttggtaagtggcagaaggagccaggcttaggtttgaagtgagactgactttattcccttcttcctccttacgtagctctggatgccgggcaggttggtttggcactgtcctatgccctcacgctcatggggatgtttcagtggtgtgttcgacaaagtgctgaagttgagaatatgatgcctgtaatcccagctactagagaggctgaggcaggagaatcgcttgaacctgggaggcggaggttgtggtgagccgagatctcacaattgcactccagcctgggcaacaagagtga

SEQ ID NO: 353739 - DNA, 5833 bp, Homo sapiens
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatatgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 353740 - DNA, 5271 bp, Homo sapiens
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatatgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctgtattaactgcttggggtaccgagc

SEQ ID NO: 353741 - DNA, 5284 bp, Homo sapiens
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatatgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctcttggcttaaacccggttgaatgagacaaactgagacaactttaaatttggcccaaaggccaaactttgtcgggaacgccctttttccgtgcacaacaccgacgacccccacccttttctacaaacccaaacaacgtgtacaacctttcgggccccaacgcacagcccctcccaccgcgccgcccacgaccgcactaacgccccggccacttctacaactcccctctcccccacaaggggcggacaacttggggca

SEQ ID NO: 353742 - DNA, 3200 bp, Homo sapiens
ggcagggtcccctcaggctattgggaacatttatttttccttgaaacatgaagcctcctaggaggcctgcgtgtgctgtttggtggatacgtgaccatggagcttgggaggccgcaggtttttctgcacccagcctcactgagctgttttctctgtctgtttccccagctcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 353743 - DNA, 2420 bp, Homo sapiens
aagatcttatcaatccaaattttaccttcgggttctgacgatttaaggaagaaaatgtcaatcataccgaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 353744 - DNA, 1688 bp, Homo sapiens
tcacagaaagccacggtaccattgtgtatgtgtatcgtatattgcctgtatcacttagctttctggaatctaaaggttccttgggtgtgcaactttggtgccctactccacgtaaaaatcttctgtagctcaactgagcaaaacacactcgcacattcatctacttattcatcatgcttattaccgttctcaaagtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 353745 - DNA, 1182 bp, Homo sapiens
actcaatgtctgggctccaaaccatgcataatatccacaactaaaatggccatgtcaccaagagagcttcctctatttctcagattactggaagattcatgcccaggagtatccataatttagcattcctgggatccggacattctctctatcccaatttttaatcatctgagtctgtattaactgcttgccagcagttaatacagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 353746 - DNA, 1118 bp, Homo sapiens
taaactagtccaggttcccacagctcgtaagctgctgtctcttgtctcccaggtctcagctcagctgtgtctttgggacatctttccagaccattcactctgtaggagccacctaccgctgagtctgtagcagttaatacagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 353747 - DNA, 1531 bp, Homo sapiens
  misc_feature (1411)..(1411): n is a, c, g, or t
  misc_feature (1441)..(1441): n is a, c, g, or t
  misc_feature (1477)..(1477): n is a, c, g, or t
  misc_feature (1498)..(1498): n is a, c, g, or t
  misc_feature (1515)..(1515): n is a, c, g, or t
caagcagggcatgagttcaccaccccagtaacaacagtgcattacaatacttaataatggaacaaggagagtagtattttagtctcaaaagcattggcacttacaacctattgctttgtttttagtggtttccagctgtggttgcattgcacgtagaaagtggaataatgtaatgggctttgaaaccataataatgaatgtctgaataatgacattatttcttgcgtttgtaatactgttaattaaatctatgtcgatcctgttggaattcataaaatcatctaaaaatttttctaaatatacagtgttgttttccccattgtatcttgatctcaagcaacaaatggtaaaagtatagctattaatgtcattaaatgtgaattgtttcaacattatgaagggttcctcttggtaagtggcagaaggagccaggcttaggtttgaagtgagactgactttattcccttcttcctccttacgtagctctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttttacaaggtgggtggccaaccacttggggccagggcnggaggccgcttgcccttcacttggaaaccngccaaaccgggttttactttcccaaagggatttttnccccctttttgggttcaccantggaccccttggggttnccaaccctttcccttt

SEQ ID NO: 353748 - DNA, 1019 bp, Homo sapiens
  misc_feature (998)..(998): n is a, c, g, or t
  misc_feature (1005)..(1006): n is a, c, g, or t
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgtggtaagacgngatcctnngagtcactcgcag

SEQ ID NO: 353749 - DNA, 377 bp, Homo sapiens
tttgctgctagtggttttgaggacctagccggctttattggcttatatttgtatttagtttgtatttaacctctagatctttgactactgtgttgtctttgactacggtttcaaaatgtatgtttttcaatgtggagcaccccattcatgcattttttcaccctgtgccttttacatttataggtgtatttgtcaaattttgcatgagaagatcacaattttagtgactcatcagttgcagtacctcaaagctgcaagtcagattctgatattgaaagatgtaagtagtttctagaggtctcccgaacttgcaagtacttgggtgtgttgaatccccttcttcttcctccatttcatgttcctttcttctcagagct

SEQ ID NO: 353750 - DNA, 5862 bp, Homo sapiens
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatatgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcagaggcttggttcttgtttttgacaacgtcccgctggttcgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttacatgcagtgacattcaggtcgcgtttcggttgtcatgagatcagagggtttttgatccagacccacccccgccccaccccgcgcgcctttgctgcctcttccagagacccagcttgcagagcggccgc

SEQ ID NO: 353751 - DNA, 3284 bp, Homo sapiens
caagcagggcatgagttcaccaccccagtaacaacagtgcattacaatacttaataatggaacaaggagagtagtattttagtctcaaaagcattggcacttacaacctattgctttgtttttagtggtttccagctgtggttgcattgcacgtagaaagtggaataatgtaatgggctttgaaaccataataatgaatgtctgaataatgacattatttcttgcgtttgtaatactgttaattaaatctatgtcgatcctgttggaattcataaaatcatctaaaaatttttctaaatatacagtgttgttttccccattgtatcttgatctcaagcaacaaatggtaaaagtatagctattaatgtcattaaatgtgaattgtttcaacattatgaagggttcctcttggtaagtggcagaaggagccaggcttaggtttgaagtgagactgactttattcccttcttcctccttacgtagctctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaaaatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 353752 - DNA, 2602 bp, Homo sapiens
cctccacctcctgggttcaagtgattctcctgtctcagcctcccgagtagctggaattacaggcgcaccccaccctgcctggctactttttgtatttttagtagagatgggatttcaccatgttggccaggctggtcttgaacttctgaccaccagtgaaccacctgcctcggcctcccaaagtgctgggattacaggcatgagccaccacacccagcctggtcacatgtttaatatcagcttgtcttatgaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgaccgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcaacagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctcca

SEQ ID NO: 353753 - DNA, 3521 bp, Homo sapiens
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacatctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgatcgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagggggatgaatttggcttcgtttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatatgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttgtcatcttctctccaggggctctggaccatccgggcatacaaagcagaagagaggtgtcaggaactgtttgatgcacaccaggatttacattcaggtctgtctatttctggaaatggtttcaaaggacaggatctgctgctttttctggcttaacctccctggtcagatgagcttgttggcaggcacctcagggcccagccccacatcctgctttttttgcgcatcttcgtctccttccccatccccttcttctgggcttggactcctctcggaatcgctgctgcacgttccctctttgtgccccctgactggcttgtggggtctttctctcaccatgcatggcctgtggctctgtcagcaaacgttttctgcaaaaggccacctagtaagtgttttaggcattgtgtgccattattgtctctgttgtgattaatcacctttgccattgtagcacaaaagcagatgtcaatacattggcaaatggctgtgactatgtttcaataaaactttatttacaaaaataggtgctggctcacgtgctgtagtttgctgaccccttgcatcagtgaagattttttcaatatggaaatttcagaatttccaccaaatctacaaaattcagatccgtcattccaatctttattttatcttgctgattaaatggcactttaaaaaccacatgctaaaaggaaaa

SEQ ID NO: 353754 - DNA, 406 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatcactttgggaggccgaggtggagtgatcatcagcctgggcaacacggcaagaccctatctctattaaaaaaaaaaaaaaaacaaaaacaacaacaacaaaaaaaaaaacaaaaaaaaaacgagccgg

SEQ ID NO: 353755 - DNA, 415 bp, Homo sapiens
agagtgcagtggcgcgatctcactcactgcaacctctgcctcctgggctcaagcaatcctccatctcagcctcccaagtagctgggaccacagcggtgcaccaccatgcccggctaatttttgtattttttgtagagacaggggtctcactatgttgccaaggctggtcttgaactcctgggctcaagcgatccctcccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353756 - DNA, 3106 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaagaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353757 - DNA, 3292 bp, Homo sapiens
  misc_feature (3110)..(3110): n is a, c, g, or t
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaagaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaatttanaaacagcagaacaagacaagaacacgtgcggagagtacaaagtacggggcgcgaaaaacaagagctatcaaggggacatgtgcacaagggtaccctgacccggttgctggcgacacagggggagacactgcgggcccccatagaggcagaatactcggaagccggtacgatggagcgacaga

SEQ ID NO: 353758 - DNA, 3201 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaagaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaagaccagcctggccaacatggtgaaaccctgtttcccaggctgattaaagtttctataaggtatgtttattcttaaggatatctactctaacacctgtaaatgtagggtgatcaattagtaaattaattgattcagatttat

SEQ ID NO: 353759 - DNA, 3172 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaagaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaattccttgcctctttttgtttcagtcaattctgttgggtattctttaatctgcatccaaaactattat

SEQ ID NO: 353760 - DNA, 3257 bp, Homo sapiens
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaagaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353761 - DNA, 962 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353762 - DNA, 1586 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaagaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353763 - DNA, 3045 bp, Homo sapiens
  misc_feature (5)..(5): n is a, c, g, or t
  misc_feature (22)..(22): n is a, c, g, or t
  misc_feature (28)..(28): n is a, c, g, or t
  misc_feature (63)..(63): n is a, c, g, or t
gcagncccccttgaacgcaccncagganggtttgttttttggaaccaccagcaaagaagaacntttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaagaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353764 - DNA, 3793 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagaggtatgtttttccttaagtaaaaataagtataaaacaacttcttcaggtaacctataaattatgtagtaatttctttacaaggaatttctaacaatactattcacatgtattttagttcttctgagactaaattctcatctattctagtgagaggagaattaggtaatgggctggattctgaattcttctagtggttaagaatgtaaactctggaatcattcatatatgaggtgatagaatcaaaccacagtttaaacctttggttttaaaagatcagtttcatctcaggtttgctaacttcttggagctgtctctttctctgtcaagtagataaagactgaacaagatgacatcatgtagttagacgaaatagtgctcattacaatgatcagagatgccaggacttatatgtgaagtctgtaatcctactgtcctctttttcattttgttatgtagcaatatggaaaaaagaagttgtttttttcaatacatttaattttaacaatgcttccacatgactttataaatgagagctatttttatttatagtttattacaaatccactgagaagtctggaatgtatggaatcagagagctagatcaaaaaacatggttgaacagcaaaaattagatgtaagtagaattttaatctataatttacattaataactcatttcctttgttttttagttttttgagtggttttaatcctcttctttttaaaatgtttctttttcttgatgatactttttgcatctctgttgtgtagccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccaggcatggtggctcacaccagtaatctcagcactttgggaggccgaggcaggcgggtcacttgaggtcaggagttcgagaccagcctggccaacatggtgaaaccctgtttctactaaaaatacaaaaattagctgggcgtggtggtgcatgcctgtaatcccagctacttgggaggctaaggtaggagaattacttgaacatgggagatggaggttgcagtgagccaagatcatgccactgcattccaacctgggcaagggagtgagacgctgtctcaaaaaaaaaaaaaagaaaatttcctatcttctgaagttccaagccaaagctatttttaaaacatcaataaaaaaatttaagttacttacttgcattatctttgttagccatggcattcatgccaatgttatcaaacttggatcccatattttcatccaatagatggccaaacttttaaacaaaaacgataaatttattagaaaactaaaaataatgtagaatagctagcttgttaaaacagtacattagccttacctcttcagcagatacaaataggctggaatcatttaagtttcttttcttttttcttggccctaaaaaaaattgtaagtctacattattcaattataaatctaatgattttagaaaaatgcaatgcaacatgattttattttaaaaattatacttgggtaaaaacaattgcaataatcttctggcaccattgggtagctggcatttaaatataatttaagagttagtatataatattttcaaaaagctaacaacatcctaatagaactgttcagatgacaagagtgtcttcttgcttttcagatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353765 - DNA, 999 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaagtaatttttgtagtctgcaaggttttttttttttttgctttagtctaaatacttgttaatcttacatgttctcctgagagaagaaaaagccattcctttcaggttgtaaagtaccatgaaaaggtctttcaaaaatattcctatcagccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353766 - DNA, 1920 bp, Homo sapiens
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353767 - DNA, 1769 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatatttggccactgatcgaagttttacccataagggaaataacatagtatcaagcaatagtaaaattatcagtttgacatggatgggttttgaaatacttaagacacaacataaaatttagttcaggggtctttagattgtaaagaaattgactgaaagtatgtttattatgctataaatgaagttgtttataacagcgaaaaaggttctcctttaaaaaaaaaacttatctgtagtactgaatatataaacttttcctgaaacaattattcaaactctgcatctttgatatcaatgtctctagcagtagtagagccatattttaaaaagagctttactaaatacagatcataacattcagctgttttaagtgtattaacgcatttgggtaaatttacagacttgttcaaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353768 - DNA, 934 bp, Homo sapiens
tgcgcatgcgcagtcccccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaactaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353769 - DNA, 867 bp, Homo sapiens
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353770 - DNA, 819 bp, Homo sapiens
tgcgcatgcgcagtcccccttgaacgcacctcagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactcttggtggtcccacagaacatgctgctgagtcacaggaacttctagcctgccttggcctgtggtttcccacccactatacaaacccactgcttgtttgttgcttttcttctcatatttattgtcaaagataaatgtttcaaaaagaaatgactaaggaaggaaaagaaacaaatgctctaaagattttctctccccaagcacttttactggtgaaataaaaaccagtaacaatcaatatgtaaaaacggcccacttccctaaaaaaaactaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353771 - DNA, 1053 bp, Homo sapiens
  misc_feature (871)..(871): n is a, c, g, or t
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaatttanaaacagcagaacaagacaagaacacgtgcggagagtacaaagtacggggcgcgaaaaacaagagctatcaaggggacatgtgcacaagggtaccctgacccggttgctggcgacacagggggagacactgcgggcccccatagaggcagaatactcggaagccggtacgatggagcgacaga

SEQ ID NO: 353772 - DNA, 1022 bp, Homo sapiens
acattttcttaatccagtctatgattgttggaaatttgggttggttccaagtctttgctattgttaatagtgctgcaataaacatacgtgtgcatgcgtctttatagcagcatgatttatagtcctttgggtatataaccagtaatgggatggctgggtcaaatggtatttctaattctagatcccggaggaatcacctcactgacttccacaatggttgaactagtttccagtcccaccaacagtgcaaaagtgttcccatttttccacatcctttccagcacctgttgtttcctgactttttaatgatattgttttgtgaggccttcgtggtattgatttttattaaggtgatatgtatgttacttaacagctgtataatacacatttgcatgcattaggaagttttttttgggttttattcatcctgtagtgatgtatctgtgacctcaacgagtaggcacttctgtactgtactggtttcttaaagtttcttttatcccgcccccacccccaacctcagcctcaagtatgtaacaccatgcctggctaatttttgattttttttttttttttttgagacagagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggtttcatcatgttggccaggatggtcttatctgttgaccttgtgatctacctgccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353773 - DNA, 735 bp, Homo sapiens
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccagtcatcacgttcagcctcccatctaagctgtttgagacctttgagagaagaagaaaagatgagtgtactaccacactgtagactccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353774 - DNA, 789 bp, Homo sapiens
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatagtctcgctttgtcgccaggctggagtacaggggcgtgatctcggctcactgcaacctctgccttctgggttcaagcgattctcctgcctcagcctcccaagtagctgggcctacaagtgcatgccaccacgccaagctaatttttgtatttttagtagagatggggccaacatggtgaaaccccgtctctactaaaaatacaaaaattagctgggcgtggtggtgggcgcctgtaatcccagctacttgggaggctgagccaggagaatggcttgaacccggaaggcggacgttacagtgagccacaatcatgccactgcactccagcctggtgacagaggaagactctgtctcaaaa

SEQ ID NO: 353775 - DNA, 584 bp, Homo sapiens
gcggccgcctactactactaaattcgcggccgcgtcgaccttgaacgcacctcaggatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaattccttgcctctttttgtttcagtcaattctgttgggtattctttaatctgcatccaaaactattat

SEQ ID NO: 353776 - DNA, 563 bp, Homo sapiens
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagccttggcctcccaaagtgctgggattacaggcgtgagccactgcgcccagccatttttgattttttgtagagatggggtctcattgtgttgcccaggctgattaaagtttctataaggtatgtttattcttaaggatatctactctaacacctgtaaatgtagggtgatcaattagtaaattaataaatctgaatcaattaataaatctgtttaaaat

SEQ ID NO: 353777 - DNA, 435 bp, Homo sapiens
cctcaggcattgaaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagtttggtagccgaacttgtaggcgtttttggagcatattttttgtttagcaagatgcacacaagccaagatttcaggcaaacaatgagcaagaaatatcccttcatcttggaagaggtatgtttttccttaagtaaaaataagtataaaacaacccttcatcttggaaggtatgttttatacttatttttacttaaggaaaaac

SEQ ID NO: 353778 - DNA, 154 bp, Homo sapiens
gatctttaaaggagtttggtagccgaacttgtaggcgtttttggagcatattttttgtttagcaagatgcacacaagccaaggtaatcataattcagaagttaatgctttctaaaggggtatagttttgctaatccattttatgtgttaaatgg

SEQ ID NO: 353779 - DNA, 2164 bp, Homo sapiens
tccccaacgatggtcctcagctccaaggaagaggagcagcagcggctgatcaatgacctcacagcacagagagcgcgcctgcaaacagaatcaggtgaatattcacgccagctagatgaaaaggacacactagtttcacagctctcgaggggcaaacaagcctttactcaacagattgaggaactgaaaaggcaacttgaagaggagataaaggccaagagtgccctggcacatgccctgcagtcctcccgccatgactgtgacctgctgcgggaacagtatgaggaggagcaggaagccaaggccgagctacagagagcaatgtccaaggccaacagtgaggttgcccagtggaggaccaaatatgagacagatgccatccagcgcacagaggagctggaggaggccaagaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatctgcagcaggagatttctgatctcactgaacagattgcagaaggaggaaagcgcatccatgaactggaaaaaataaagaagcaagttgagcaagaaaagtctgaacttcaggctgccttagaggaggcagaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggatacccagctccacctagatgatgctctccggagccaagaggacctgaaggaacagctggctatggtggagcgcagagccaacctgctgcaggctgagatcgaggagctgcgggccactctggaacagacagagaggagcaggaaaatcgcagaacaggagctcctggatgccagtgagcgtgttcagctcctgcacacccagaacaccagcctgatcaacaccaagaagaagctggagacagacatttcccaaatccagggagagatggaagacatcatccaggaagcccgcaatgcagaagagaaggccaagaaggccatcactgatgctgccatgatggctgaggagctgaagaaggaacaggacaccagcgcccatctggagcggatgaagaagaacctggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgccaaaaaaaaaaa

SEQ ID NO: 353780 - DNA, 5994 bp, Homo sapiens
ggtctctcctcataaagcttcaagttctgatccactttaaggtcgcatctctacgccagggtccttaactgggctaccatcaataacctgcagccatgagttccgactctgagatggccatttttggggaggctgctcctttcctccgaaagtctgaaagggagcgaattgaagcccagaacaagccttttgatgccaagacatcagtctttgtggtggaccctaaggagtcctttgtgaaagcaacagtgcagagcagggaaggggggaaggtgacagctaagaccgaagctggagctactgtaacagtgaaagatgaccaagtcttccccatgaaccctcccaaatatgacaagatcgaggacatggccatgatgactcatctacacgagcctgctgtgctgtacaacctcaaagagcgctacgcagcctggatgatctacacctactcaggcttgttctgtgtcactgtcaacccctacaagtggttgccagtgtataatgcagaggtggtgacagcctaccgaggcaaaaagcgccaggaggccccaccccacatcttctccatctctgacaatgcctatcagttcatgctgactgatcgggagaatcagtctatcttgatcaccggagaatctggcgcagggaagactgtgaacaccaagcgtgtcatccagtactttgcaacaattgcagttactggggagaagaagaaggaagaagttacttctggcaaaatgcaggggactctggaagatcaaatcatcagtgccaaccccctactggaggcctttggcaacgccaagaccgtgaggaatgacaactcctctcgctttggtaaattcatcaggatccacttcggtaccacagggaaactggcttctgctgatattgaaacatatcttctggagaagtctagagttactttccagctaaaggctgaaagaagctatcatattttttatcagatcatgtctaacaagaagccagatctaattgaaatgctcctgatcaccaccaacccatacgattatgccttcgtcagtcaaggggagatcacagtgcccagcattgatgaccaagaagagttgatggctacagatagtgccattgaaattctgggcttcacttcagatgaaagagtgtccatctataagctcacaggggctgtgatgcattatgggaacatgaaattcaagcaaaagcagcgtgaggagcaagctgagccagatggcactgaagttgctgacaaggcagcctatctccaaaatctgaactctgcagatctgctcaaagccctctgctaccctagggtcaaggtcggcaatgagtatgtcaccaaaggtcaaactgtgcagcaggtgtacaatgcagtgggtgctctggccaaagctgtctacgataagatgttcttgtggatggtcacccgcatcaaccagcagctggacaccaagcagcccaggcagtacttcattggggtcttggacattgctggctttgagatctttgatttcaacagcctggagcagctgtgcatcaacttcaccaatgagaaactgcaacagtttttcaaccaccacatgttcgtgctggagcaggaggagtacaagaaggaaggcattgagtggacgttcattgactttgggatggacctggctgcctgcatcgagctcatcgagaagcctatgggcatcttctccatcctggaagaggagtgcatgttccccaaggcgacagacacctccttcaagaacaagctgtatgaacaacatcttggaaaatccaataacttccagaagcccaagcctgccaaaggcaagcctgaggcccacttctctttgattcactatgctggcaccgtggactacaacattgccggctggcttgacaagaacaaggaccccctgaatgagactgtggtggggctgtaccagaagtctgcaatgaagactctggctctcctctttgttggggcaacgggagcggaagcagaggctggcggtggaaagaaaggtggtaagaagaagggttcttctttccagactgtgtctgctctcttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggtgttaaatgcaagtgctatccctgaaggacaattcatcgatagcaagaaggcttcagagaagctcctggggtccattgacattgaccacacccagtataaatttggtcacaccaaggtctttttcaaagctggtcttctggggctcctagaggagatgcgagatgagaagctggcccagctgattacccgaacccaggccatgtgcagagggttcttggcaagagtggagtaccagaaaatggtggaaagaagagagtccatcttctgcatccagtacaatgtccgtgccttcatgaatgtcaagcactggccctggatgaaactctatcttcaagatcaagcctctgttgaaaagtgcagaaactgagaaggagatggccaccatgaaggaagaatttcagaaaaccaaagacgaacttgccaagtcagaggcaaaaaggaaggaactggaagaaaagatggtgacgctgttgaaagaaaaaaatgacttgcagctccaagttcaggctgaagccgacaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaaggatctttggaacaagaaaagaaaatccggatggatctagaaagagcaaagagaaaactagagggagacctaaaattggctcaagaatccgcaatggatatagaaaatgacaaacaacaacttgatgaaaagcttaaaaagaaagagtttgaaatgagcggtctgcaaagcaagattgaagatgaacaagcccttggtatgcagctgcagaagaaaatcaaggagttacaagcccgcattgaggagctggaggaggaaatcgaggcagagcgggcctcccgggccaaagcagagaagcagcgctctgatctctcccgggagctggaggagatcagtgagaggctggaagaagccggtggggccacctcggcccagattgagatgaacaagaagcgggaagctgagttccagaaaatgcgcagggacctggaggaggccaccctacagcatgaggccacggcggccaccctgaggaagaagcatgcagatagtgtggccgagcttggggagcagattgacaacctgcagcgagtgaagcagaagctggagaaggagaagagtgagatgaagatggagatcgatgaccttgctagtaacatggagactgtctccaaagccaagggaaaccttgaaaagatgtgccgcgctctagaagatcaactgagtgaaattaagaccaaggaagaggagcagcagcggctgatcaatgacctcacagcacagagagcgcgcctgcaaacagaatcaggtgaatattcacgccagctagatgaaaaggacacactagtttcacagctctcgaggggcaaacaagcctttactcaacagattgaggaactgaaaaggcaacttgaagaggagataaaggccaagagtgccctggcacatgccctgcagtcctcccgccatgactgtgacctgctgcgggaacagtatgaggaggagcaggaagccaaggccgagctacagagagcaatgtccaaggccaacagtgaggttgcccagtggaggaccaaatatgagacagatgccatccagcgcacagaggagctggaggaggccaagaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatctgcagcaggagatttctgatctcactgaacagattgcagaaggaggaaagcgcatccatgaactggaaaaaataaagaagcaagttgagcaagaaaagtctgaacttcaggctgccttagaggaggcagaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggatacccagctccacctagatgatgctctccggagccaagaggacctgaaggaacagctggctatggtggagcgcagagccaacctgctgcaggctgagatcgaggagctgcgggccactctggaacagacagagaggagcaggaaaatcgcagaacaggagctcctggatgccagtgagcgtgttcagctcctgcacacccagaacaccagcctgatcaacaccaagaagaagctggagacagacatttcccaaatccagggagagatggaagacatcatccaggaagcccgcaatgcagaagagaaggccaagaaggccatcactgatgctgccatgatggctgaggagctgaagaaggaacaggacaccagcgcccatctggagcggatgaagaagaacctggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgccaaaaaaaaaaa

SEQ ID NO: 353781 - DNA, 551 bp, Homo sapiens
cagcctcagcattacgcttttgctcactctcaacctctccttccagctcccgtaccctggcctccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgccaaaaaaaaaaa

SEQ ID NO: 353782 - DNA, 6032 bp, Homo sapiens
ggtctctcctcataaagcttcaagttctgatccactttaaggtcgcatctctacgccagggtccttaactgggctaccatcaataacctgcagccatgagttccgactctgagatggccatttttggggaggctgctcctttcctccgaaagtctgaaagggagcgaattgaagcccagaacaagccttttgatgccaagacatcagtctttgtggtggaccctaaggagtcctttgtgaaagcaacagtgcagagcagggaaggggggaaggtgacagctaagaccgaagctggagctactgtaacagtgaaagatgaccaagtcttccccatgaaccctcccaaatatgacaagatcgaggacatggccatgatgactcatctacacgagcctgctgtgctgtacaacctcaaagagcgctacgcagcctggatgatctacacctactcaggcttgttctgtgtcactgtcaacccctacaagtggttgccagtgtataatgcagaggtggtgacagcctaccgaggcaaaaagcgccaggaggccccaccccacatcttctccatctctgacaatgcctatcagttcatgctgactgatcgggagaatcagtctatcttgatcaccggagaatctggcgcagggaagactgtgaacaccaagcgtgtcatccagtactttgcaacaattgcagttactggggagaagaagaaggaagaagttacttctggcaaaatgcaggggactctggaagatcaaatcatcagtgccaaccccctactggaggcctttggcaacgccaagaccgtgaggaatgacaactcctctcgctttggtaaattcatcaggatccacttcggtaccacagggaaactggcttctgctgatattgaaacatatcttctggagaagtctagagttactttccagctaaaggctgaaagaagctatcatattttttatcagatcatgtctaacaagaagccagatctaattgaaatgctcctgatcaccaccaacccatacgattatgccttcgtcagtcaaggggagatcacagtgcccagcattgatgaccaagaagagttgatggctacagatagtgccattgaaattctgggcttcacttcagatgaaagagtgtccatctataagctcacaggggctgtgatgcattatgggaacatgaaattcaagcaaaagcagcgtgaggagcaagctgagccagatggcactgaagttgctgacaaggcagcctatctccaaaatctgaactctgcagatctgctcaaagccctctgctaccctagggtcaaggtcggcaatgagtatgtcaccaaaggtcaaactgtgcagcaggtgtacaatgcagtgggtgctctggccaaagctgtctacgataagatgttcttgtggatggtcacccgcatcaaccagcagctggacaccaagcagcccaggcagtacttcattggggtcttggacattgctggctttgagatctttgatttcaacagcctggagcagctgtgcatcaacttcaccaatgagaaactgcaacagtttttcaaccaccacatgttcgtgctggagcaggaggagtacaagaaggaaggcattgagtggacgttcattgactttgggatggacctggctgcctgcatcgagctcatcgagaagcctatgggcatcttctccatcctggaagaggagtgcatgttccccaaggcgacagacacctccttcaagaacaagctgtatgaacaacatcttggaaaatccaataacttccagaagcccaagcctgccaaaggcaagcctgaggcccacttctctttgattcactatgctggcaccgtggactacaacattgccggctggcttgacaagaacaaggaccccctgaatgagactgtggtggggctgtaccagaagtctgcaatgaagactctggctctcctctttgttggggcaacgggagcggaagcagaggctggcggtggaaagaaaggtggtaagaagaagggttcttctttccagactgtgtctgctctcttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggtgttaaatgcaagtgctatccctgaaggacaattcatcgatagcaagaaggcttcagagaagctcctggggtccattgacattgaccacacccagtataaatttggtcacaccaaggtctttttcaaagctggtcttctggggctcctagaggagatgcgagatgagaagctggcccagctgattacccgaacccaggccatgtgcagagggttcttggcaagagtggagtaccagaaaatggtggaaagaagagagtccatcttctgcatccagtacaatgtccgtgccttcatgaatgtcaagcactggccctggatgaaactctatcttcaagatcaagcctctgttgaaaagtgcagaaactgagaaggagatggccaccatgaaggaagaatttcagaaaaccaaagacgaacttgccaagtcagaggcaaaaaggaaggaactggaagaaaagatggtgacgctgttgaaagaaaaaaatgacttgcagctccaagttcaggctgaagccgacaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaaggatctttggaacaagaaaagaaaatccggatggatctagaaagagcaaagagaaaactagagggagacctaaaattggctcaagaatccgcaatggatatagaaaatgacaaacaacaacttgatgaaaagcttaaaaagaaagagtttgaaatgagcggtctgcaaagcaagattgaagatgaacaagcccttggtatgcagctgcagaagaaaatcaaggagttacaagcccgcattgaggagctggaggaggaaatcgaggcagagcgggcctcccgggccaaagcagagaagcagcgctctgatctctcccgggagctggaggagatcagtgagaggctggaagaagccggtggggccacctcggcccagattgagatgaacaagaagcgggaagctgagttccagaaaatgcgcagggacctggaggaggccaccctacagcatgaggccacggcggccaccctgaggaagaagcatgcagatagtgtggccgagcttggggagcagattgacaacctgcagcgagtgaagcagaagctggagaaggagaagagtgagatgaagatggagatcgatgaccttgctagtaacatggagactgtctccaaagccaagggaaaccttgaaaagatgtgccgcgctctagaagatcaactgagtgaaattaagaccaaggaagaggagcagcagcggctgatcaatgacctcacagcacagagagcgcgcctgcaaacagaatcaggtgaatattcacgccagctagatgaaaaggacacactagtttcacagctctcgaggggcaaacaagcctttactcaacagattgaggaactgaaaaggcaacttgaagaggagataaaggccaagagtgccctggcacatgccctgcagtcctcccgccatgactgtgacctgctgcgggaacagtatgaggaggagcaggaagccaaggccgagctacagagagcaatgtccaaggccaacagtgaggttgcccagtggaggaccaaatatgagacagatgccatccagcgcacagaggagctggaggaggccaagaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatctgcagcaggagatttctgatctcactgaacagattgcagaaggaggaaagcgcatccatgaactggaaaaaataaagaagcaagttgagcaagaaaagtctgaacttcaggctgccttagaggaggcagaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggatacccagctccacctagatgatgctctccggagccaagaggacctgaaggaacagctggctatggtggagcgcagagccaacctgctgcaggctgagatcgaggagctgcgggccactctggaacagacagagaggagcaggaaaatcgcagaacaggagctcctggatgccagtgagcgtgttcagctcctgcacacccagaacaccagcctgatcaacaccaagaagaagctggagacagacatttcccaaatccagggagagatggaagacatcatccaggaagcccgcaatgcagaagagaaggccaagaaggccatcactgatgctgccatgatggctgaggagctgaagaaggaacaggacaccagcgcccatctggagcggatgaagaagaacctggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgccaaaaaaaaaaa

SEQ ID NO: 353783 - DNA, 6003 bp, Homo sapiens
ggtctctcctcataaagcttcaagttctgatccactttaaggtcgcatctctacgccagggtccttaactgggctaccatcaataacctgcagccatgagttccgactctgagatggccatttttggggaggctgctcctttcctccgaaagtctgaaagggagcgaattgaagcccagaacaagccttttgatgccaagacatcagtctttgtggtggaccctaaggagtcctttgtgaaagcaacagtgcagagcagggaaggggggaaggtgacagctaagaccgaagctggagctactgtaacagtgaaagatgaccaagtcttccccatgaaccctcccaaatatgacaagatcgaggacatggccatgatgactcatctacacgagcctgctgtgctgtacaacctcaaagagcgctacgcagcctggatgatctacacctactcaggcttgttctgtgtcactgtcaacccctacaagtggttgccagtgtataatgcagaggtggtgacagcctaccgaggcaaaaagcgccaggaggccccaccccacatcttctccatctctgacaatgcctatcagttcatgctgactgatcgggagaatcagtctatcttgatcaccggagaatctggcgcagggaagactgtgaacaccaagcgtgtcatccagtactttgcaacaattgcagttactggggagaagaagaaggaagaagttacttctggcaaaatgcaggggactctggaagatcaaatcatcagtgccaaccccctactggaggcctttggcaacgccaagaccgtgaggaatgacaactcctctcgctttggtaaattcatcaggatccacttcggtaccacagggaaactggcttctgctgatattgaaacatatcttctggagaagtctagagttactttccagctaaaggctgaaagaagctatcatattttttatcagatcatgtctaacaagaagccagatctaattgaaatgctcctgatcaccaccaacccatacgattatgccttcgtcagtcaaggggagatcacagtgcccagcattgatgaccaagaagagttgatggctacagatagtgccattgaaattctgggcttcacttcagatgaaagagtgtccatctataagctcacaggggctgtgatgcattatgggaacatgaaattcaagcaaaagcagcgtgaggagcaagctgagccagatggcactgaagttgctgacaaggcagcctatctccaaaatctgaactctgcagatctgctcaaagccctctgctaccctagggtcaaggtcggcaatgagtatgtcaccaaaggtcaaactgtgcagcaggtgtacaatgcagtgggtgctctggccaaagctgtctacgataagatgttcttgtggatggtcacccgcatcaaccagcagctggacaccaagcagcccaggcagtacttcattggggtcttggacattgctggctttgagatctttgatttcaacagcctggagcagctgtgcatcaacttcaccaatgagaaactgcaacagtttttcaaccaccacatgttcgtgctggagcaggaggagtacaagaaggaaggcattgagtggacgttcattgactttgggatggacctggctgcctgcatcgagctcatcgagaagcctatgggcatcttctccatcctggaagaggagtgcatgttccccaaggcgacagacacctccttcaagaacaagctgtatgaacaacatcttggaaaatccaataacttccagaagcccaagcctgccaaaggcaagcctgaggcccacttctctttgattcactatgctggcaccgtggactacaacattgccggctggcttgacaagaacaaggaccccctgaatgagactgtggtggggctgtaccagaagtctgcaatgaagactctggctctcctctttgttggggcaacgggagcggaagcagaggctggcggtggaaagaaaggtggtaagaagaagggttcttctttccagactgtgtctgctctcttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggtgttaaatgcaagtgctatccctgaaggacaattcatcgatagcaagaaggcttcagagaagctcctggggtccattgacattgaccacacccagtataaatttggtcacaccaaggtctttttcaaagctggtcttctggggctcctagaggagatgcgagatgagaagctggcccagctgattacccgaacccaggccatgtgcagagggttcttggcaagagtggagtaccagaaaatggtggaaagaagagagtccatcttctgcatccagtacaatgtccgtgccttcatgaatgtcaagcactggccctggatgaaactctatcttcaagatcaagcctctgttgaaaagtgcagaaactgagaaggagatggccaccatgaaggaagaatttcagaaaaccaaagacgaacttgccaagtcagaggcaaaaaggaaggaactggaagaaaagatggtgacgctgttgaaagaaaaaaatgacttgcagctccaagttcaggctgaagccgacaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaaggatctttggaacaagaaaagaaaatccggatggatctagaaagagcaaagagaaaactagagggagacctaaaattggctcaagaatccgcaatggatatagaaaatgacaaacaacaacttgatgaaaagcttaaaaagaaagagtttgaaatgagcggtctgcaaagcaagattgaagatgaacaagcccttggtatgcagctgcagaagaaaatcaaggagttacaagcccgcattgaggagctggaggaggaaatcgaggcagagcgggcctcccgggccaaagcagagaagcagcgctctgatctctcccgggagctggaggagatcagtgagaggctggaagaagccggtggggccacctcggcccagattgagatgaacaagaagcgggaagctgagttccagaaaatgcgcagggacctggaggaggccaccctacagcatgaggccacggcggccaccctgaggaagaagcatgcagatagtgtggccgagcttggggagcagattgacaacctgcagcgagtgaagcagaagctggagaaggagaagagtgagatgaagatggagatcgatgaccttgctagtaacatggagactgtctccaaagccaagggaaaccttgaaaagatgtgccgcgctctagaagatcaactgagtgaaattaagaccaaggaagaggagcagcagcggctgatcaatgacctcacagcacagagagcgcgcctgcaaacagaatcaggtgaatattcacgccagctagatgaaaaggacacactagtttcacagctctcgaggggcaaacaagcctttactcaacagattgaggaactgaaaaggcaacttgaagaggagataaaggccaagagtgccctggcacatgccctgcagtcctcccgccatgactgtgacctgctgcgggaacagtatgaggaggagcaggaagccaaggccgagctacagagagcaatgtccaaggccaacagtgaggttgcccagtggaggaccaaatatgagacagatgccatccagcgcacagaggagctggaggaggccaagaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatctgcagcaggagatttctgatctcactgaacagattgcagaaggaggaaagcgcatccatgaactggaaaaaataaagaagcaagttgagcaagaaaagtctgaacttcaggctgccttagaggaggcagaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggatacccagctccacctagatgatgctctccggagccaagaggacctgaaggaacagctggctatggtggagcgcagagccaacctgctgcaggctgagatcgaggagctgcgggccactctggaacagacagagaggagcaggaaaatcgcagaacaggagctcctggatgccagtgagcgtgttcagctcctgcacacccagaacaccagcctgatcaacaccaagaagaagctggagacagacatttcccaaatccagggagagatggaagacatcatccaggaagcccgcaatgcagaagagaaggccaagaaggccatcactgatgctgccatgatggctgaggagctgaagaaggaacaggacaccagcgcccatctggagcggatgaagaagaacctggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtgatcatgtcctgccaagcactagtgtcctgccaagcactagtgtcctgccaagcactagtgtcctgccaagcactagtgtcctgccaa

SEQ ID NO: 353784 - DNA, 765 bp, Homo sapiens
  misc_feature (44)..(44): n is a, c, g, or t
  misc_feature (109)..(109): n is a, c, g, or t
  misc_feature (163)..(163): n is a, c, g, or t
cgccgaccgcggacgtccggcagctttatcagccagagtgcccntgaactgctcgcgtttctattttaatcgccctgcatcggatcacgcggcgtgccccaaccatgtncagacgcagcccgtagacaccagctccagaaatcaccacccaaggatcttaaanggagaagaaggaagattgtggaagaggcgagaacctggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgccaaaaaaaaaaa

SEQ ID NO: 353785 - DNA, 2318 bp, Homo sapiens
caggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaatttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatattgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgtta

SEQ ID NO: 353786 - DNA, 672 bp, Homo sapiens
ataagtgtcaaatagtctgatctggacttcaaatatgcccagcaggttaataagaaatatacttctgtggccaggatgcacgagctctggttccctcaagtactacaggagacgcttccttttacatgtttgttttgctccggtctctctcggtgatgactttgggttttgactataggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggttagtggtaggccaggtagattttcagaattttacaaattttacttaacaatgtccctcctttttcctaaggataactcaaactatcctttgtttcctggaatctaacatcaaatactaagtccagtatgagcaaagctctgctctttaatgatataacttgtcatttattaaagtaatagtcacagcctacatgtgttacactcagtgtgtaaataactgtgaagaggcaattgtcagatagcaaattgggcacctgctgtgtacggtatattgcactggggctgacgggtgtgtaggacatgatatttgccctcagaaaaacttgtgaaagggataaaagcaagaatag

SEQ ID NO: 353787 - DNA, 687 bp, Homo sapiens
caggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaagtgcgtgcccggcggccgggggctggcggggcccgggtggaggccgaggccggggccggggccggggcggaggcaaagggggccct

SEQ ID NO: 353788 - DNA, 2166 bp, Homo sapiens
  misc_feature (25)..(25): n is a, c, g, or t
  misc_feature (198)..(198): n is a, c, g, or t
gggaaccatgtgctccgggtggcantcttggatgtcagggaagcctaggaaggcccgacgggggtttgcaggctttgagctctaaaatgaggctccagcctgcagccgcccccttggcgaccctcagggatggctgtggaaggggctgcgtccgcagttttctgctcatcccagcctgtagttgcccatcgtggtcanactggaggatggcaaaagtgagattggtgtcaggatgtgatgagagcagggaggtggcgcagttttgcttttcctccataggaagaggaggacttccacagcagcgatagttgctaattgttgtgtagagatttccaggatgagagttgggttgctgtctggaaaaactagccagagccatgggagtgggatggtggatgcttgtctgccacgtattgctgacacttctgggctttcttttgtcttggcagtttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatattgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgtta

SEQ ID NO: 353789 - DNA, 2087 bp, Homo sapiens
ggccttttgtaaaagacaggtggtgtgacgaggagcaagctcagcccacccccaccctgctggcagggtctccccaaggacagagccatctcagcgagcagcacctccaccttgctggccttggaaccctgagtgtgtggcagtgcagagggcaaggcagtcgccctggggtgggggtagatgcccctgacttgttaattgttgaaactttttaaaaatttatttttttgagacggagtatcacgctgttgcactccagcctgggtgacagagtgagactcggtctcaaaaaaaaaaaaacaaaaaacaaacaaaaaaaaacagaaaaaaaatgttgaaagccaggcgtgatggtgtgcacctgtagtcccagctactcgggaggctgagcctgcagtgagccgtggatgtgccactgcattccagcctgagagagcaagaccctgtccaaaacaaagacagcacaactgaaaaatgggcaaagaacttgaatagacatttctccagagaagatacacagatggccaataagcccatgaaagatgcgccaagccgttagtcattagggaaatacgaatcaagacccaatgagatactacttttacacatactaggatggctattcaaaaacaaaaacaaaagcaaaatagcaagtgttggcaaggatgtggagacatcagaatccctgtgctttgccgctgggggtgtgaaatggtgcagccactgtggaagacagtatgacagctcctcagaaggttcaacatagaatcaccagagaagcataaaccccaaagaggtgaaacagggacccaaatggatgcttttctatgaatattcatggcagcacctttcacagtggccaaaaggtggaaatgactcaagtgtgctccagcagaggaatgagtaaacaaatgtgttacaagcacacaacagaatcttactcagccatgaaaaggaatgaaattctgacacaggctacagcatggatggcccgaggtcattatgctgagtgaaataagccagtcacaacagggcacaccctgcgggattccgtaaacaaggcacctagagccgtcagattcagagagacagaaagtggactggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatattgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgtta

SEQ ID NO: 353790 - DNA, 2737 bp, Homo sapiens
  misc_feature (25)..(25): n is a, c, g, or t
  misc_feature (198)..(198): n is a, c, g, or t
gggaaccatgtgctccgggtggcantcttggatgtcagggaagcctaggaaggcccgacgggggtttgcaggctttgagctctaaaatgaggctccagcctgcagccgcccccttggcgaccctcagggatggctgtggaaggggctgcgtccgcagttttctgctcatcccagcctgtagttgcccatcgtggtcanactggaggatggcaaaagtgagattggtgtcaggatgtgatgagagcagggaggtggcgcagttttgcttttcctccataggaagaggaggacttccacagcagcgatagttgctaattgttgtgtagagatttccaggatgagagttgggttgctgtctggaaaaactagccagagccatgggagtgggatggtggatgcttgtctgccacgtattgctgacacttctgggctttcttttgtcttggcagtttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatattgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgttaaaaaaaaaaaaaaagaaggcaaacaaaaaacaaaccagcaaaataacagaaagacaacacaacaaaaagagagagggcgcggcgcacgcccacaaagaatatcccctcggggggggccccccagattagactaacacccggtgttttggtgtaaccagaaggggccccccatagaaggggggccccttataataaaaaaccgcacgagcgccgaggggcgcccgccgtttataaacaccgcctgtggaacgtggaggaaaacacgcgccacagctgggaggaaccattgtggggaggagaacgcccccacaatatcggggggcgggggccaccacattattcgggaccacacctaccctccacgaggaagatatatagcgcgcccccaaggggacatatattcaaaccctttacagggtgtattaacggtggtgaaacacccgcggttaatattactccgcgagtgagaaagattgcccccccgagtttatattcttgaaacaatatttcacagccgtgtatctacatacaagtcccactctactgctcactgcagatcatctagctaatc

SEQ ID NO: 353791 - DNA, 1193 bp, Homo sapiens
tgtaactgctatttgaaaaaaaaaaagttaaaatctgtttattatataaatccccttgtgaggtaagacacaagtttgtgaatgacaccttaaaacagcgtattctaaagtcatttacttagctcttaatttgaaccttttgcactttggaagacagcagttttcatgtcagttaattcagtatgttaaccgtcacttcttcactgcaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatattgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgtta

SEQ ID NO: 353792 - DNA, 1310 bp, Homo sapiens
ggccttttgtaaaagacaggtggtgtgacgaggagcaagctcagcccacccccaccctgctggcagggtctccccaaggacagagccatctcagcgagcagcacctccaccttgctggccttggaaccctgagtgtgtggcagtgcagagggcaaggcagtcgccctggggtgggggtagatgcccctgacttgttaattgttgaaactttttaaaaatttatttttttgagacggagtatcacgctgttgcactccagcctgggtgacagagtgagactcggtctcaaaaaaaaaaaaacaaaaaacaaacaaaaaaaaacagaaaaaaaatgttgaaagccaggcgtgatggtgtgcacctgtagtcccagctactcgggaggctgagcctgcagtgagccgtggatgtgccactgcattccagcctgagagagcaagaccctgtccaaaacaaagacagcacaactgaaaaatgggcaaagaacttgaatagacatttctccagagaagatacacagatggccaataagcccatgaaagatgcgccaagccgttagtcattagggaaatacgaatcaagacccaatgagatactacttttacacatactaggatggctattcaaaaacaaaaacaaaagcaaaatagcaagtgttggcaaggatgtggagacatcagaatccctgtgctttgccgctgggggtgtgaaatggtgcagccactgtggaagacagtatgacagctcctcagaaggttcaacatagaatcaccagagaagcataaaccccaaagaggtgaaacagggacccaaatggatgcttttctatgaatattcatggcagcacctttcacagtggccaaaaggtggaaatgactcaagtgtgctccagcagaggaatgagtaaacaaatgtgttacaagcacacaacagaatcttactcagccatgaaaaggaatgaaattctgacacaggctacagcatggatggcccgaggtcattatgctgagtgaaataagccagtcacaacagggcacaccctgcgggattccgtaaacaaggcacctagagccgtcagattcagagagacagaaagtggactggtacgtgccaggggctgggggccggagcggtgtggagttagtgtttaatgggtacggagtttctgtttagggtgatgaaaaggtggtggcggctgcacagcactgtgagtggacttcacgctgctccactgtacacttacacatgcttaaaaggcaaattttatgctatattttaataccacaataaaaactgtataaacctggatt

SEQ ID NO: 353793 - DNA, 662 bp, Homo sapiens
cgaatggaaagagatagaaggtaatacgtgtgactgcttgtcaggctgactcatatatgattaccttagtcatacatggttatcacagatgagtgatccttagccgtttctgcgttcagagggaataaagcaggtaggagcatcgttagctttcccagatggatcaaggatcccccagactatgcccaggctcgctggctcactaggaggactcccgggactccgcatgcagtcactctcaggctgtgacttactatggagaaaggatgccaggtgcgatcagcaaaggcgcgtggggagaaggcaggagctgaggtgcaagcttctaagagcgcgccctgtggagtcaggcaggttgcccctcatgcccccagccatgtggtctgaaaacgtgggtgaggtgttgccaaccaggaaagctcgctagagaccaggggcgtgtcacgtaggcactgcccccatgcatgcaaccacagtccagtctcccagaaggaaagcagttgttcagtgtcagccatatcgtttgcacagtgtaggttctgggggcactcttaactccctgaatctaggtttgcagactccactaagggccagccctgactgcaggcctttctgaggagagtggtcaggctgttttggtaactgctgcttaccagccagct

SEQ ID NO: 353794 - DNA, 587 bp, Homo sapiens
aaaaacaaaaaaatacctgtgaaagttgagtgtttatgtggtatgcgaatatttttaaatcttcagtgcaactaaagttcttcaaattacgtgttagtagttttgatgtttgttaagtgcatttcatttgtgcagtaaagaggagagtaagccacatattgataaaattcctgttgcttcatttttttccagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggaggtaagcgatgaagcagcaggtagtgggagctttcttctgactgagccctgtggctgatggcattttggccttggggggcaggggagacagatggtttgtacacatgtgaaacagtcttggaggtgtctgtgtatctcaggggtctgtccacccgcttccctgtcttttcgctttaaacattattctgattctcaaacataattaatcttggtgtgagaacgttgcgtttgag

SEQ ID NO: 353795 - DNA, 437 bp, Homo sapiens
gcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgttactctgtagccagtcattaatctgaaggtttaatatatcattttattgggatgagatcatagtctttacacaaatgctatgta

SEQ ID NO: 353796 - DNA, 1458 bp, Homo sapiens
  misc_feature (25)..(25): n is a, c, g, or t
  misc_feature (198)..(198): n is a, c, g, or t
gggaaccatgtgctccgggtggcantcttggatgtcagggaagcctaggaaggcccgacgggggtttgcaggctttgagctctaaaatgaggctccagcctgcagccgcccccttggcgaccctcagggatggctgtggaaggggctgcgtccgcagttttctgctcatcccagcctgtagttgcccatcgtggtcanactggaggatggcaaaagtgagattggtgtcaggatgtgatgagagcagggaggtggcgcagttttgcttttcctccataggaagaggaggacttccacagcagcgatagttgctaattgttgtgtagagatttccaggatgagagttgggttgctgtctggaaaaactagccagagccatgggagtgggatggtggatgcttgtctgccacgtattgctgacacttctgggctttcttttgtcttggcagtttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcttcgactgccctgaggtcatccctgaaactcgagcacgg

SEQ ID NO: 353797 - DNA, 1304 bp, Homo sapiens
ataagtgtcaaatagtctgatctggacttcaaatatgcccagcaggttaataagaaatatacttctgtggccaggatgcacgagctctggttccctcaagtactacaggagacgcttccttttacatgtttgttttgctccggtctctctcggtgatgactttgggttttgactataggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatattgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgtta

SEQ ID NO: 353798 - DNA, 1679 bp, Homo sapiens
tagtaaatttattttttaattgtaacaaatatatgccattagtatgttcttaagttttgggtcacattggcaacagtgtctttattttttttttgaaattcttttcaggaatcctaaggttatagttcccttaaaaaaatatttgctgttttacctcttttaagactgtaaacaggacaaaaaggcatggatatgagaattagctagtgatcactggctattctaaatagtcactaaggcttgaattgtctcttcaccagatgcctgtcagaagtcccaaaggtttccctgatcatattaataactttataaaaaattgatcattattcattaaatattagatattagtaaggaaaatataaatgaagtctaaaccaaaactcttaaccagactaacttcaatgttatgaatcacaaaatctttttgattgattgctctattgacaagctcttatatgcttttagagaaagattaagtcccattataagagatgataaattttagtcaaagactagaacacaacttacagaatacataactggacttgacagttaacaacttagttatttacactgtacaatggaacaaagaaaaatcttaattcttctgcctttattgctgtatttgaccattcaggaatactttggctttcatatttacaattaaatctccttgttcaaacgtaaaatatgtatatttcctatatgcaacttttaaagataatgtttccattaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaacttattataaaagtatatacttgaagacttgttacagccatcaaataggcagtgagctctggtgaatttctctacattcataatgctttaagttttttaaagaatatgagggtaaattcagcaattttaagatttaaaattggagtttatatatacttatttatacatgtgttaagattctcaaatcctatgatatatacacagatgtagacatacacacatataggttatgaggttgagccgtatgttttgttaaatatctagcaaaattaaattgagcttaaactatttaattttgaaaattagtgacattaaattgttgtctttaaattaccactcagttatagtgaagagaatccagcctttgtccaagcttaggagcttactattacttatgtttttatggctagagattaaaattaatttgctggtttttaataaaattttgaataggtacttgaaactggaaaattcatttcttcacaaatggtagaaaacatattgatgtttcataatgaacagaaaccttgagatatttttaaatatgg

SEQ ID NO: 353799 - DNA, 1131 bp, Homo sapiens
tagtaaatttattttttaattgtaacaaatatatgccattagtatgttcttaagttttgggtcacattggcaacagtgtctttattttttttttgaaattcttttcaggaatcctaaggttatagttcccttaaaaaaatatttgctgttttacctcttttaagactgtaaacaggacaaaaaggcatggatatgagaattagctagtgatcactggctattctaaatagtcactaaggcttgaattgtctcttcaccagatgcctgtcagaagtcccaaaggtttccctgatcatattaataactttataaaaaattgatcattattcattaaatattagatattagtaaggaaaatataaatgaagtctaaaccaaaactcttaaccagactaacttcaatgttatgaatcacaaaatctttttgattgattgctctattgacaagctcttatatgcttttagagaaagattaagtcccattataagagatgataaattttagtcaaagactagaacacaacttacagaatacataactggacttgacagttaacaacttagttatttacactgtacaatggaacaaagaaaaatcttaattcttctgcctttattgctgtatttgaccattcaggaatactttggctttcatatttacaattaaatctccttgttcaaacgtaaaatatgtatatttcctatatgcaacttttaaagataatgtttccattaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaa

SEQ ID NO: 353800 - DNA, 875 bp, Homo sapiens
cagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgaggtttgatattataagttttatcatacaattatagaataaagaattagttttggtagacattgtattattgttaagtggtttgtctggatctctgaaatatcttattaatatagtgcctatgttttgtgtaataaataaataaaagatttaaatctgaattgtttaaaagg

SEQ ID NO: 353801 - DNA, 5030 bp, Homo sapiens
cagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaaaaaaaaaagtcgacgcggccgcgaatttaa

SEQ ID NO: 353802 - DNA, 1489 bp, Homo sapiens
acaaaggtgagtgggtagagggaggcagtaatatgaagtgactgctgtgtattttaactaccagatttttctatatttgccactgtgaaatagttggaaaggggacattctgattacgcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactataggaaaatgataaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaa

SEQ ID NO: 353803 - DNA, 327 bp, Homo sapiens
tattatgttttctcataaaatactaattagcatttaatgataggaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaaggtaggaacagagttttaaacttgtacaaagtttaatcatttcaaattttggcattgttttaaaagacaacactattctggataacctggtttcttcctgatgaacagtttg

SEQ ID NO: 353804 - DNA, 5964 bp, Homo sapiens
aagcttaatactgagcatcaagaaattctttaataaatataagtgatatttattaagacgtgtaataaggaaatgttcatgtcttatttttgtgttagatttttttagaatctacttttgttagagttttataaatacagttagtgtttgagatagaaagagaaaagaattagttttcttcctcttctacctgctcatgaacttgatttttttctcccaacaattgaagagccaagaaaaagggagattcttaagagatgggaaatagaatctcatctacccctgtttccctcagaacagtgaaactgaatcttaagggtaagatagaatagtgtgtacttaacttagatggagaagaaaggctgccaaaatgagatctgaagcgctattacaaatatttccatcattactgtacttcagaatgaattacaaccgtaagtttttttacttcctcattcataaatttgattattccttataccacttctcagctttcatcattctttattgtacttttctatgtaatgtttgcctattatacagcaacttaagagaactgtaagtttggacatttcattttggtgttgataatagaatatctttgaatagttctatagttgatgagtagaaccatgaaccaagtaacttaaagtccttgatgttatttattacagagaactataatagaagctctcccgctaatgtttccatcatgtgtacaaaaagttttcttgttattaaagccagtccgtttaacttacaataagcataaatagctaagctgtgaaagttacctgtgataatgctaattttcccatttattaaaaggcaagttgttttccgatcataagaaatttagaaaagccatccaaagataaattccgagtgatatattcctgctgtttgttatgttttctcaaattaattgagttttattttacaatgacaggagttattaaagtattttatttttattatgattaagattttcaaagtaacatttcttatatgaaagaaattatgttaatgcatgtttttcttacatgggaaatcatatattttaaaaatgattttaaaattcgttttactttaagttgtattatctttctcaaaagtggctagtgcttcaccagaaaaaaagacaccagcataactcagtgtatctttatttacataggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaa

SEQ ID NO: 353805 - DNA, 4882 bp, Homo sapiens
cagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtgctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagagggtctggtagaagtggaaagacaatcccagaactggaaaaaaccattggtttaatgaaaaaagtagttgaaaaagtccagagagaaaatgaacagttgaaaaaagcatcaggaatattgactagtgaaaaaatggctaatattgagcaggaaaatgaaaaattgaaggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaa

SEQ ID NO: 353806 - DNA, 4835 bp, Homo sapiens
cagatggattcggatgaaatgaaaaaaatacttgcagaaaatagtaggaaaattactgttttgcaagtgaatgaaaaatcacttataaggcaatatacaaccttagtagaattggagcgacaacttagaaaagaaaatgagaagcaaaagaatgaattgttgtcaatggaggctgaagtttgtgaaaaaattgggtgtttgcaaagatttaaggaaatggccattttcaagattgcagctctccaaaaagttgtagataatagtgtttctttgtctgaactagaactggctaataaacagtacaatgaactgactgctaagtacagggacatcttgcaaaaagataatatgcttgttcaaagaacaagtaacttggaacacctggagtgtgaaaacatctccttaaaagaacaagtggagtctataaataaagaactggagattaccaaggaaaaacttcacactattgaacaagcctgggaacaggaaactaaattaggtaatgaatctagcatggataaggcaaagaaatcaataaccaacagtgacattgtttccatttcaaaaaaaataactatgctggaaatgaaggaattaaatgaaaggcagcgggctgaacattgtcaaaaaatgtatgaacacttacggacttcgttaaagcaaatggaggaacgtaattttgaattggaaaccaaatttgctgagcttaccaaaatcaatttggatgcacagaaggtggaacagatgttaagagatgaattagctgatagtgtgagcaaggcagtaagtgatgctgataggcaacggattctagaattagagaagaatgaaatggaactaaaagttgaagtgtcaaaactgagagagatttctgatattgccagaagacaagttgaaattttgaatgcacaacaacaatctagggacaaggaagtagagtccctcagaatgcaactgctagactatcaggcacagtctgatgaaaagtcgctcattgccaagttgcaccaacataatgtctctcttcaactgagtgaggctactgctcttggtaagttggagtcaattacatctaaactgcagaagatggaggcctacaacttgcgcttagagcagaaacttgatgaaaaagaacaggctctctattatgctcgtttggagggaagaaacagagcaaaacatctgcgccaaacaattcagtctctacgacgacagtttagtggagctttacccttggcacaacaggaaaagttctccaaaacaatgattcaactacaaaatgacaaacttaagataatgcaagaaatgaaaaattctcaacaagaacatagaaatatggagaacaaaacattggagatggaattaaaattaaagggcctggaagagttaataagcactttaaaggataccaaaggagcccaaaaggtaatcaactggcatatgaaaatagaagaacttcgtcttcaagaacttaaactaaatcgggaattagtcaaggataaagaagaaataaaatatttgaataacataatttctgaatatgaacgtacaatcagcagtcttgaagaagaaattgtgcaacagaacaagtttcatgaagaaagacaaatggcctgggatcaaagagaagttgacctggaacgccaactagacatttttgaccgtcagcaaaatgaaatactaaatgcggcacaaaagtttgaagaagctacaggatcaatccctgaccctagtttgccccttccaaatcaacttgagatcgctctaaggaaaattaaggagaacattcgaataattctagaaacacgggcaacttgcaaatcactagaagagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggagcaaagagaaattgtgaagaaacatgaggaagaccttcatattcttcatcacagattagaactacaggctgatagttcactaaataaattcaaacaaacggcttgggatttaatgaaacagtctcccactccagttcctaccaacaagcattttattcgtctggctgagatggaacagacagtagcagaacaagatgactctctttcctcactcttggtcaaactaaagaaagtatcacaagatttggagagacaaagagaaatcactgaattaaaagtaaaagaatttgaaaatatcaaattacagcttcaagaaaaccatgaagatgaagtgaaaaaagtaaaagcggaagtagaggatttaaagtatcttctggaccagtcacaaaaggagtcacagtgtttaaaatctgaacttcaggctcaaaaagaagcaaattcaagagctccaacaactacaatgagaaatctagtagaacggctaaagagccaattagccttgaaggagaaacaacagaaagcacttagtcgggcacttttagaactccgggcagaaatgacagcagctgctgaagaacgtattatttctgcaacttctcaaaaagaggcccatctcaatgttcaacaaatcgttgatcgacatactagagagctaaagacacaagttgaagatttaaatgaaaatcttttaaaattgaaagaagcacttaaaacaagtaaaaacagagaaaactcactaactgataatttgaatgacttaaataatgaactgcaaaagaaacaaaaagcctataataaaatacttagagagaaagaggaaattgatcaagagaatgatgaactgaaaaggcaaattaaaagactaaccagtggattacagggcaaacccctgacagataataaacaaagtctaattgaagaactccaaaggaaagttaaaaaactagagaaccaattagagggaaaggtggaggaagtagacctaaaacctatgaaagaaaagaatgctaaagaagaattaattaggtgggaagaaggtaaaaagtggcaagccaaaatagaaggaattcgaaacaagttaaaagagaaagagggggaagtctttactttaacaaagcagttgaatactttgaaggatctttttgccaaagccgataaagagaaacttactttgcagaggaaactaaaaacaactggcatgactgttgatcaggttttgggaatacgagctttggagtcagaaaaagaattggaagaattaaaaaagagaaatcttgacttagaaaatgatatattgtatatgagggcccaccaagctcttcctcgagattctgttgtagaagatttacatttacaaaatagatacctccaagaaaaacttcatgctttagaaaaacagttttcaaaggatacatattctaagccttcaatttcaggaatagagtcagatgatcattgtcagagagaacaggagcttcagaaggaaaacttgaagttgtcatctgaaaatattgaactgaaatttcagcttgaacaagcaaataaagatttgccaagattaaagaatcaagtcagagatttgaaggaaatgtgtgaatttcttaagaaagaaaaagcagaagttcagcggaaacttggccatgttagaggggctgaattagaaaaacttaaagctcatcttgggcatcagttgagcatgcactatgaatccaagaccaaaggcacagaaaaaattattgctgaaaatgaaaggcttcgtaaagaacttaaaaaagaaactgatgctgcagagaaattacggatagcaaagaataatttagagatattaaatgagaagatgacagttcaactagaagagactggtaagagattgcagtttgcagaaagcagaggtccacagcttgaaggtgctgacagtaagagctggaaatccattgtggttacaagaatgtatgaaaccaagttaaaagaattggaaactgatattgccaaaaaaaatcaaagcattactgaccttaaacagcttgtaaaagaagcaacagagagagaacaaaaagttaacaaatacaatgaagaccttgaacaacagattaagattcttaaacatgttcctgaaggtgctgagacagagcaaggccttaaacgggagcttcaagttcttagattagctaatcatcagctggataaagagaaagcagaattaatccatcagatagaagctaacaaggaccaaagtggagctgaaagcaccatacctgatgctgatcaactaaaggaaaaaataaaagatctagagacacagctcaaaatgtcagatctagaaaagcagcatttgaaggaggaaataaagaagctgaaaaaagaactggaaaattttgatccttcattttttgaagaaattgaagatcttaagtataattacaaggaagaagtgaagaagaatattctcttagaagagaaggtaaaaaaactttcagaacaattgggagttgaattaactagccctgttgctgcttctgaagagtttgaagatgaagaagaaagtcctgttaatttccccatttactaaaggtcacctataaactttgtttcatttaactatttattaactttataagttaaatatacttggaaataagcagttctccgaactgtagtatttccttctcactaccttgtacctttatacttagattggaattcttaataaataaaattatatgaaattttcaa

SEQ ID NO: 353807 - DNA, 694 bp, Homo sapiens
ctctgggagagagactcagaaagtcatccaggtagcccagttcactgggggagtccagggaaggtccagcacccagcctggaggtctggaaacacctctcgaggaggtgacaacagaaacggttttggagccaggcgcggtagctcacgcttgtaatcccagcactttgggaggccgaggtaggcggatcacttgaggtcaggagtttgagaccagcctggccaacatggtgaaaccccgtctctactaaaaatataaaaagtaaggccgggcgctgtggctcactcttgtaatcccagcactttggggggctgaggcgggcatataaatataaatgtgaatataaattagccggacatggtgctgcatgccccagttactccagttactcaggaggctgaggcacgagaatcgcttggacccgagaggcggaggttgcagtgagctgagatcgcaccactgcactctagcctcagcctgggcgacagagcaagactctgtctcaaaaaaaaaaaaaagaaaaaaagaaaaaaagaaatggttttgaatgacagctgaggatttggtcagtatgaaatgggtgagggctgggcgcggtggctcacgcctgtaatcccagcactttgggaggctgaggcgggcagatcaccaggtcaagagaggctgaggcaggagaatctcttgaacctgggag

SEQ ID NO: 353808 - DNA, 1885 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353809 - DNA, 791 bp, Homo sapiens
tctattaattcactttaatacccccatttcaacagaccccccacttcaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353810 - DNA, 601 bp, Homo sapiens
  misc_feature (18)..(18): n is a, c, g, or t
  misc_feature (24)..(25): n is a, c, g, or t
gggcccgacagaattgtntttggnngggtttttcgggattagcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353811 - DNA, 529 bp, Homo sapiens
tacctaaccaattcccaccaccaccacaactacctcgacgacttcctcagggtgacctttcacagcagttggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353812 - DNA, 968 bp, Homo sapiens
ggacgcgtgggtcgacccacgcgtcgactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaaggaaaggccttggttaccgcgggaaaagggaattctctccagagacaaaatgtggaaaaggacaaagcacgaagtgtgaccatacagagatatacagaagggattcctttatgggggacggaaacccacgaaatttataattttaatttggttgggtttcaaaattataggctacggttaataaatacaccaagaggcaaattttatattacccacaagaaacccttatcacggaggattaaaagcctttataccaaaaaagggattgggtttacaccaagggagaatttttttacacaataatacttttattaaattttgcggaaa

SEQ ID NO: 353813 - DNA, 389 bp, Homo sapiens
taaacagagttggaaagcattttactgaaagcaaaatatttagagaaaatagacatttatacaaaattataaaatgcttgtaataagaataagtgcatttcaaggaaagcacaaacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353814 - DNA, 1859 bp, Homo sapiens
  misc_feature (3)..(3): n is a, c, g, or t
canaagaaaagtttgtaaaaaaagaggtggtacggtccggaattcccgggagggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353815 - DNA, 2717 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatatattttggactgttgtgcactgtgattactactttaaggactaaatgtatttctcattattttgaatcaaagtcctccgtttattaacagcaatacccacatcctcttcatagcctattaacaacagaggtaaaactattattcaaattcaaaaactacggtattgcctttgctgtggcagttaccatcaccttcacactctaaggtagcaggtgacatttaaagcctgcttaaatgtcagaatttataaagtgggaatctcatctgaactttatacctgatttttagaagcaaattagcttctaccaaattagctaattagcatgccatattcacacttagaacaactgattagtaaagtcacttgactaaaaacagaatttctttataaaccacttaacatatttactcctgtacacagactattcaagaaaaacaaaatggtaaatttaatagttcagacatcttagacaagacttgacttttgggcttcagcaagatgtggaaacttttttaaaagaatttttgctttctttctctctaaattttccttccgtgctttgatgcgggctcgtttctcacgttccagtctgagaaaatggtccacataaggcaaggcaaagaatcgtttcctattgtatcttttatttaggtgccaaggtataacccactgcttgaacttgtgccagatgattcttccaaagatgtctcttctccaagcaccaggtctagctctttcttgaccagtctgaagaagccttagggcatcttctctttcctggacaactttatctaatgcatccatggaatctacggttgtccttcgggtggacg

SEQ ID NO: 353816 - DNA, 2515 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatatattttggactgttgtgcactgtgattactactttaaggactaaatgtatttctcattattttgaatcaaagtcctccgtttattaacagcaatacccacatcctcttcatagcctattaacaacagaggtaaaactattattcaaattcaaaaactacggtattgcctttgctgtggcagttaccatcaccttcacactctaaggtagcaggtgacatttaaagcctgcttaaatgtcagaatttataaagtgggaatctcatctgaactttatacctgatttttagaagcaaattagcttctaccaaattagctaattagcatgccatattcacacttagaacaactgattagtaaagtcacttgactaaaaacagaatttctttataaaccacttaacatatttactcctgtacacagactattcaagaaaaacaaaatggtaaatttaatagttcagacatcttagacaagacttgacttttgggcttcagcaagatgtggaaacttttttaaaagaatttttgctttctttctctctaaattttccttccgtgctttgatgcgggaacgtttctcacgttgtcactctgaaagaattttttcttattttaataacttgatcttgtgt

SEQ ID NO: 353817 - DNA, 2509 bp, Homo sapiens
  misc_feature (2481)..(2482): n is a, c, g, or t
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatatattttggactgttgtgcactgtgattactactttaaggactaaatgtatttctcattattttgaatcaaagtcctccgtttattaacagcaatacccacatcctcttcatagcctattaacaacagaggtaaaactattattcaaattcaaaaactacggtattgcctttgctgtggcagttaccatcaccttcacactctaaggtagcaggtgacatttaaagcctgcttaaatgtcagaatttataaagtgggaatctcatctgaactttatacctgatttttagaagcaaattagcttctaccaaattagctaattagcatgccatattcacacttagaacaactgattagtaaagtcacttgactaaaaacagaatttctttataaaccacttaacatatttactcctgtacacagactattcaagaaaaacaaaatggtaaatttaatagttcagacatcttagacaagacttgacttttgggcttcagcaagatgtggaaacttttttaaaagaatttttgctttctttctctctaaattttccttccgtgctttgatgcgggcacgttttcacgttgcagtatagagaanngtctgtgactatgattaataatattac

SEQ ID NO: 353818 - DNA, 1918 bp, Homo sapiens
  misc_feature (1910)..(1910): n is a, c, g, or t
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatataaaaaaaagaaaacaaaagacaccanacaaaaca

SEQ ID NO: 353819 - DNA, 1637 bp, Homo sapiens
tttttgtagagttgggggtctcactatggtgccgaggctgatcttgaactccgtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353820 - DNA, 2021 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcgtatccttgaaagagtaatacctttcctcttgaactttattcatcatctacttcactaaacaggataaccttcagggaaaaggcagttttggtgcaccattgtgtgtctactgtgttaaaggaattttagtgccagatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353821 - DNA, 1830 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353822 - DNA, 2275 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcgtatccttgaaagagtaatacctttcctcttgaactttattcatcatctacttcactaaacaggataaccttcagggaaaagatttgctaatggtcgttctactgggctgattttggacagtggagccactcataccactgcaattccagtccacgatggctatgtccttcaacaaggtaaatgtatttaaccaggatacactgagatgattttagatgccatgaggatgcacataatgaaataaaatgatgagtagcactattaaagcatatcagtttctgaataagattttttttaagtatgttaaaaatctttagtatataatgtatatttaaaactgatgcatggctttatttatgtgttgaaggatagttcagttcattctacctgaaaaagttattcacataaatacacccacagaggaaattcgttcaaggaagtttggacttactgccctcttagccttgtttcatctgtttcataggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353823 - DNA, 1823 bp, Homo sapiens
ccctagtgattggctgataggaggagccagcaagtgtggctgagctccggggtgtgtggacgccgctttgttgcctgagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcgtatccttgaaagagtaatacctttcctcttgaactttattcatcatctacttcactaaacaggataaccttcagggaaaagatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353824 - DNA, 1894 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgcttgtgttacgcgttgagtacacttaccccagaaaagttaagatagatacgtagccttgctgg

SEQ ID NO: 353825 - DNA, 1535 bp, Homo sapiens
agaatcgtcttctacatttcttcctttattttactttcagaccgtgctgaggtacttgcagttctctgacctcgctgtgttctcttgcttcttggtcttcccacatgctcctactcttgcccatattcccttccccagattttactattgaatatctcaggaataggtttcccttttacatcaccatcttccctgggacatcctgagcttttctttttacagctttattcatcatctacttcactaaacaggataaccttcagggaaaaggcagttttggtgcaccattgtgtgtctactgtgttaaaggaattttagtgccagatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353826 - DNA, 1124 bp, Homo sapiens
taaacagagttggaaagcattttactgaaagcaaaatatttagagaaaatagacatttatacaaaattataaaatgcttgtaataagaataagtgcatttcaaggaaagcacaaacttaatttatagagccagttaaagctttaaaaaatttaagtggaaattgaaatatgcaaaaatgtataaacattctacaaaagatggtcatgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353827 - DNA, 1203 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaaggaaaggccttggttaccgcgggaaaagggaattctctccagagacaaaatgtggaaaaggacaaagcacgaagtgtgaccatacagagatatacagaagggattcctttatgggggacggaaacccacgaaatttataattttaatttggttgggtttcaaaattataggctacggttaataaatacaccaagaggcaaattttatattacccacaagaaacccttatcacggaggattaaaagcctttataccaaaaaagggattgggtttacaccaagggagaatttttttacacaataatacttttattaaattttgcggaaa

SEQ ID NO: 353828 - DNA, 1088 bp, Homo sapiens
ttgggatgataattaggttggtgttggatgaaatgaaataataaagacttagcacagcaccagatttatagtgttaggtgtggatttgctattttaggatagaaattgtgaatgctatacttcagtatgcagctttttaaagtttgtatgttttctcatcatataatcgcatgttaaaagccataatcaaagtacttttaaaagtctgtacattagtctaacctatgcttgttatcttggctatttcaaaattaccgtattttaatcagtgtttgaaccacagggagccattatgaagtctgtcaaaattgaatttcctggctgggtgcaagtggctcatgcatgtaatcccagcactttgggaggctgagatgggccgattgcttgagtgcaaatgtgaagaccagcctggacaatatggcgaggaagacccctgtctctatttaaaaaaaaaaaaaaaaaaagaattttctaagttgagtcacaagatttgattgtactaatgcatattcttctatttcagagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353829 - DNA, 611 bp, Homo sapiens
ctaatgaagaagaggttacgttttacagagacgcgaaaaagccctataggtgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353830 - DNA, 626 bp, Homo sapiens
gcggccatcaggccagggcagatatgtgttggttgtccggacgaacgcgggaggggttacgatgatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353831 - DNA, 620 bp, Homo sapiens
  misc_feature (58)..(58): n is a, c, g, or t
ttcccctctccttcttcttcaacttacccccccaccacgtacacaccccctcgaaatnatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353832 - DNA, 619 bp, Homo sapiens
ctaatgtagtatactctttaatgtcggaacaacatctaaacacaaaattcagaatcatggcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353833 - DNA, 625 bp, Homo sapiens
cgtactctgcccctatcacgttttgtctagcaccatgacataacgacccccccccttacgatgatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353834 - DNA, 750 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatgggtatgatgttttccccatggaattgattatggagtgtacatgttatattttagatacaaagtagtagcttcctataagttgaacatcaaccatggttttttgttttgttttgttttttattccacaaactgatttccagacactgagaatacaaagatgcataagaaatgttccttttcattaaaagcttacagttagttgggggaaatagatgtatatatacaaataatggtacactgtgggataagtggtacaatataggtatgtgcaatgag

SEQ ID NO: 353835 - DNA, 754 bp, Homo sapiens
acaagtttgaccttccttcaataaagggggtcataaggaacaaaagtcctccgtttattaacagcaatacccacatcctcttcatagcctattaacaacagaggtaaaactattattcaaattcaaaaactacggtattgcctttgctgtggcagttaccatcaccttcacactctaaggtagcaggtgacatttaaagcctgcttagaagcaaattagcttctaccaaattagctaattagcatgccatattcacacttagaacaactgattagtaaagtcacttgactaaaaacagaatttctttataaaccacttaacatatttactcctgtacacagactattcaagaaaaacaaaatggtaaatttaatagttcagacatcttagacaagacttgacttttgggcttcagcaagatgtggaaacttttttaaaagaatttttgctttctttctctctaaattttccttccgtgctttgatgcgggctcgtttctcacgttccagtctgagaaaatggtccacataaggcaaggcaaagaatcgtttcctattgtatcttttatttaggtgccaaggtataacccactgcttgaacttgtgccagatgattcttccaaagatgtctcttctccaagcaccaggtctagctctttcttgaccagtctgaagaagccttagggcatcttctctttcctggacaactttatctaatgcatccatggaatctacggttgtccttcgggtggacg

SEQ ID NO: 353836 - DNA, 594 bp, Homo sapiens
gggaggtttataaagggggggcccatctgcacttatccctgtttttagaagcaaattagcttctaccaaattagctaattagcatgccatattcacacttagaacaactgattagtaaagtcacttgactaaaaacagaatttctttataaaccacttaacatatttactcctgtacacagactattcaagaaaaacaaaatggtaaatttaatagttcagacatcttagacaagacttgacttttgggcttcagcaagatgtggaaacttttttaaaagaatttttgctttctttctctctaaattttccttccgtgctttgatgcgggctcgtttctcacgttccagtctgagaaaatggtccacataaggcaaggcaaagaatcgtttcctattgtatcttttatttaggtgccaaggtataacccactgcttgaacttgtgccagatgattcttccaaagatgtctcttctccaagcaccaggtctagctctttcttgaccagtctgaagaagccttagggcatcttctctttcctggacaactttatctaatgcatccatggaatctacggttgtccttcgggtggacg

SEQ ID NO: 353837 - DNA, 195 bp, Homo sapiens
ttggcctcctgctctagggttagaagcatgtttctttctttcagtaagacatacctatacaaaagaacacaaaccttgtgatgctattctgtggttatgttaataaagttgtgatttctgacatcaaaattaattatctgtacttgaaagtcacttagaggcgaggtgctgtggctcacacctgtaatcccagca

SEQ ID NO: 353838 - DNA, 228 bp, Homo sapiens
atgttaggagtcagtcatgttgtcaccacaagtgttgggatgtgtgatattgacatcagaccagtaagtgccagtctcctgttacggtttaaaggtatcttttaggggactgaaatgtccccaaatcattgttaggttgacagtgatctaatggttgtcagtgtcattgactttgaggttcattttataacagtatatgtaaaaagatgaagtactagaaaaggaaaa

SEQ ID NO: 353839 - DNA, 509 bp, Homo sapiens
ataaatccagcagtagtatcatcagaaggccatacaattcttctgtacttcctattatcattctgatcacattctgggcctctaataagtatttattgaattgaataacatttacttcatattttaggtctgttagattaattacatttgggacaggtctgggggctggagggaccaaaaagaagttctatatatctagaaggcaaaggtaatctctatataaagtaatgtggtatgaagttgatctgtaaaatcagtaggttctgtatactaaagtattaattgttaagtcatagaaacaatttctcaaaagatgctatattcatcttcaactatgcattatttccaagttactaatcttatattctagttgaagactgggatagtttccaagctattttggatcatacctacaaaatgcatgtcaaatcagaagccagtctccatcctgttctcatgtcagaggcaccggtgagataaagattttctttttcacgtttctctagttg

SEQ ID NO: 353840 - DNA, 1741 bp, Homo sapiens
ccctagtgattggctgataggaggagccagcaagtgtggctgagctccggggtgtgtggacgccgctttgttgcctgagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353841 - DNA, 800 bp, Homo sapiens
ggacgcgtgggtcgacccacgcgtcgacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttggttagtagatgagctactttgcaaaaatattcttactgaattatactaaatttagtaaaaatacaaaaaataattc

SEQ ID NO: 353842 - DNA, 1712 bp, Homo sapiens
ggacgcgtgggtcgacccacgcgtcggtggacgccgctttgttgcctgagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353843 - DNA, 1908 bp, Homo sapiens
  misc_feature (3)..(3): n is a, c, g, or t
canaagaaaagtttgtaaaaaaagaggtggtacggtccggaattcccgggagggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggaaggtgagtgagtgcggccggacgagagagcgcgccttttcggcgtgtgggatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353844 - DNA, 2101 bp, Homo sapiens
  misc_feature (1914)..(1914): n is a, c, g, or t
  misc_feature (1918)..(1918): n is a, c, g, or t
  misc_feature (1925)..(1925): n is a, c, g, or t
  misc_feature (1930)..(1930): n is a, c, g, or t
  misc_feature (1932)..(1933): n is a, c, g, or t
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatataaaaaaaaaaaaaaatggactcgttggccncacnggggganctttncnnccgttccgtttagcgagggttaccccccgatcctcgctgactcagtcgtgtcttccggcgcctgagctgttgccaatgggcgcacctcactaatacgcccgctctcggtatacccacgattactgggataccccgcgaacaacccagttatattacggctctcccccg

SEQ ID NO: 353845 - DNA, 2926 bp, Homo sapiens
  misc_feature (2777)..(2777): n is a, c, g, or t
  misc_feature (2780)..(2780): n is a, c, g, or t
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatatattttggactgttgtgcactgtgattactactttaaggactaaatgtatttctcattattttgaatcaaagtcctccgtttattaacagcaatacccacatcctcttcatagcctattaacaacagaggtaaaactattattcaaattcaaaaactacggtattgcctttgctgtggcagttaccatcaccttcacactctaaggtagcaggtgacatttaaagcctgcttaaatgtcagaatttataaagtgggaatctcatctgaactttatacctgatttttagaagcaaattagcttctaccaaattagctaattagcatgccatattcacacttagaacaactgattagtaaagtcacttgactaaaaacagaatttctttataaaccacttaacatatttactcctgtacacagactattcaagaaaaacaaaatggtaaatttaatagttcagacatcttagacaagacttgacttttgggcttcagcaagatgtggaaacttttttaaaagaatttttgctttctttctctctaaattttccttccgtgctttgatgcgggctcgtttctcacgttccagtctgagaaaatggtccacataaggcaaggcaaagaatcgtttcctattgtatcttttatttaggtgccaaggtataacccactgcttgaacttgtgccagatgattcttccaaagatgtctcttctccaagcaccaggtctagctctttcttgaccagtctgaagaagccttagggcatcttctctttcctggacaactttatctaatgcatccatggaatctactaccttatctaaccgctctggacttggcattggcaatctctgccgcttggcctcctgctctagggttagaagcatgtttctttctttcagtaagacataccaaagtttgtgtaaatcttcattacttttgttccttagttgctgacaggtccatgctgctccagattttactttttcttgcccccagttttttgggtcatcaaaaaattcttctagtcctttccttgacaatgtggtatgaagtaatctatattggtgaaaggatgtcacatttggtgtactcttaggcaacaaactaaganaanacctgcaacccgagtgagcagcgtccttgggatttactagggaacaagctgccttcaggaacgctgaggctcttctacaaatacccactagactggtcgcagccatgtttctaatggagaccgtcagtttcacctaggccagcaat

SEQ ID NO: 353846 - DNA, 1987 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcctttattcatcatctacttcactaaacaggataaccttcagggaaaaggcagttttggtgcaccattgtgtgtctactgtgttaaaggaattttagtgccagatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353847 - DNA, 1829 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353848 - DNA, 1762 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctg

SEQ ID NO: 353849 - DNA, 1663 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatata

SEQ ID NO: 353850 - DNA, 1683 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttgggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacacacatatatactcttaacctactcataggctctattaaaggcacgttctagctgttgaatggggcgcagg

SEQ ID NO: 353851 - DNA, 1483 bp, Homo sapiens
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaattccagtccacgatggctatgtccttcaacaaggcattgtgaaatcccctcttgctggagactttattactatgcagtgcagagaactcttccaagaaatgaatattgaattggttcctccatatatgattgcatcaaaagaagctgttcgtgaaggatctccagcaaactggaaaagaaaagagaagttgcctcaggttacgaggtcttggcacaattatatgtgtaattgtgttatccaggattttcaagcttcggtacttcaagtgtcagattcaacttatgatgaacaagtggctgcacagatgccaactgttcattatgaattccccaatggctacaattgtgattttggtgcagagcggctaaagattccagaaggattatttgacccttccaatgtaaaggggttatcaggaaacacaatgttaggagtcagtcatgttgtcaccacaagtgttgggatgtgtgatattgatatcagaccaggtctctatggcagtgtaatagtggcaggaggaaacacactaatacagagttttactgacaggttgaatagagagctgtctcagaaaactcctccaagtatgcggttgaaattgattgcaaataatacaacagtggaacggaggtttagctcatggattggcggctccattctagcctctttggttagtagatgagctactttgcaaaaatattcttactgaattatactaaatttagtaaaaatacaaaaaataattc

SEQ ID NO: 353852 - DNA, 849 bp, Homo sapiens
  misc_feature (738)..(738): n is a, c, g, or t
  misc_feature (749)..(749): n is a, c, g, or t
  misc_feature (780)..(780): n is a, c, g, or t
ccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatggttgaagactgggatagtttccaagctattttggatcatacctacaaaatgcatgtcaaatcagaagccagtctccatcctgttctcatgtcagaggcaccgtggaatactagagcaaagagagagaaactgacagagttaatgtttgaacactacaacatccctgccttcttcctttgcaaaactgcagttttgacagcatttgctaatggtcgttctactgggctgattttggacagtggagccactcataccactgcaaanttcccaagttncccccaaaacccggaaaattttggggggggncccctttttaaaattttgggggtttttcccccccctttttttttccccaaaaaaacccccaaaaaaagg

SEQ ID NO: 353853 - DNA, 707 bp, Homo sapiens
  misc_feature (558)..(558): n is a, c, g, or t
  misc_feature (561)..(561): n is a, c, g, or t
agagcagtgcagcttgttacctcagtgacttctaaggtatcccctcttcacatcggtcagcacatcatgattgctgaccggaattattgtgatctcttagatttaccttgcgtcggtaccagctctggctctgaccgatcatataaagagttcttgcctggaaaacccgttgcgctctttcttgaccagtctgaagaagccttagggcatcttctctttcctggacaactttatctaatgcatccatggaatctactaccttatctaaccgctctggacttggcattggcaatctctgccgcttggcctcctgctctagggttagaagcatgtttctttctttcagtaagacataccaaagtttgtgtaaatcttcattacttttgttccttagttgctgacaggtccatgctgctccagattttactttttcttgcccccagttttttgggtcatcaaaaaattcttctagtcctttccttgacaatgtggtatgaagtaatctatattggtgaaaggatgtcacatttggtgtactcttaggcaacaaactaaganaanacctgcaacccgagtgagcagcgtccttgggatttactagggaacaagctgccttcaggaacgctgaggctcttctacaaatacccactagactggtcgcagccatgtttctaatggagaccgtcagtttcacctaggccagcaat

SEQ ID NO: 353854 - DNA, 3000 bp, Homo sapiens
cccccaatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 353855 - DNA, 760 bp, Homo sapiens
ttttcacactgccagacccagaagttgagtgggagacctgtttctttagaaggcaacgtcctgggtcccaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 353856 - DNA, 277 bp, Homo sapiens
  misc_feature (41)..(41): n is a, c, g, or t
ccataccccttctcgacccaaaaaacaaacacaccccccgncctttcaggagaaacggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353857 - DNA, 276 bp, Homo sapiens
ccggtggcggtgtgcgtcccccccggaccgggggccgggcggctgggaataacagagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353858 - DNA, 280 bp, Homo sapiens
tatgtagagaggggatgataaagtcgagcgggcaaccaaggattctgagggataaacagagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353859 - DNA, 279 bp, Homo sapiens
gaatagaaatatgttctatgatagtatttgtaagaaccgcggggttaggggaaacaggagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353860 - DNA, 278 bp, Homo sapiens
tacggacattcatatctttgataataaatacacgagcggagggcttgggagtaacagagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353861 - DNA, 277 bp, Homo sapiens
cacatagatttgcgaggaccggccacgccagacccccccacgcttagcgaaaacagagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353862 - DNA, 276 bp, Homo sapiens
tagtttatctttttcatattaatattaatttgtatcgaaccccagtcagcaatacagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353863 - DNA, 274 bp, Homo sapiens
ttattctcatccgctctttaaattagacgcaggggggagctttgggataacagagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353864 - DNA, 274 bp, Homo sapiens
ctgtcctcattccctttccatacaagataataaattatcctccttggtaaaaaagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353865 - DNA, 272 bp, Homo sapiens
aattcgtagaagttcctattaaataatattttttatccctcctctacctcgagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353866 - DNA, 271 bp, Homo sapiens
  misc_feature (36)..(36): n is a, c, g, or t
ataaggaaactcaaagcattaaatacccaggagggngcctagtgtaacagagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353867 - DNA, 274 bp, Homo sapiens
  misc_feature (36)..(36): n is a, c, g, or t
aaattaatatgaatttattaccatgtcacagatatnctttttagcattacaggagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353868 - DNA, 307 bp, Homo sapiens
  misc_feature (45)..(45): n is a, c, g, or t
aaataatgatgtgttaagcacccacccaccgggccgccccctagnataaacagagaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttaaaaaaaagggggaaaatggcctacgtggcctca

SEQ ID NO: 353869 - DNA, 3187 bp, Homo sapiens
cccccaatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaacatttatacttacctactttctacacactatgtctcaagacacaacatgatttttcctcctttgaccaagttggaaacctctaaccatcacaattcaggttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 353870 - DNA, 2005 bp, Homo sapiens
ctcccatttaatctgcagtggaggagagtggagctcactgtccagtagaaatcagtgatgtagcaatgttgcagtaaatagaaatgattatatatttcaatagcttagcaagaagacatttataatatttttttctttcatctgattaagttttgctgtctattttcttccagagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 353871 - DNA, 746 bp, Homo sapiens
acataaccatcaaaagtttcacggtaaacaccaaccgcaaaggcctgtggataacaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 353872 - DNA, 2531 bp, Homo sapiens
cccccaatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagtta

SEQ ID NO: 353873 - DNA, 2908 bp, Homo sapiens
cccccaatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttaaaaaaaaaaaaaaaaaaaaaaaaaaaaaaaaaaaaaaaaaaaaaaaaaaaaaaaaaaaaaaaaaaaaaaaaaaaaaaaaaaaaaaataacaaaaaaaaaaaaaaaaaaaaaacaaaaaaaaaaaaaaaccctagggggggcccccgtgaccaaattggccttatggggggtcgtttaaaattcaaggggccgccttttaaaaaaggccgactgggaaaaccctggggttccccaatttaaaccccttggagaaaatccccttttgcccgttggggttaaaccaaaagggccccaaccgattggcctttccaaaaggtggccaaaccgaatggccaatgggaaatttgtagcgtataaattttggtaaaaatccggtg

SEQ ID NO: 353874 - DNA, 746 bp, Homo sapiens
atggaggtttagtacgcaatagtgacgatgggaggagggaatgcttcggggatacaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 353875 - DNA, 3089 bp, Homo sapiens
cccccaatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaagattttaccaagaatataaagaatgtaaaatgaggtccatcacccaaggagcttgtagatttatttgggaagacaagggctacatatctggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttacagttgattttggcagttttattttttgaaggttgaaaatatgcaggttatacatgttaaaacaacaacaacactatcctataaactagaaagactagtataaaagcattattgcccactgttctcatagctaaaagttaagaaggaaagaaggaaagcaggagaaaggaaggattaattgcctgtatgtgaggaccaaacaacctttgggaactaaacagttttcagagatggcgtggcactgcatccttggttcttgctttgattggtgccctgctatagcccaaagcacgtagtatttgctgatgattcagcatgagctgcatctacctacttttagctgataattttcagttatttccctttttattttatgtcatgatttcaaagccaaaaatatgttctttttatgagtgaagaataaacttactaacaaattagtcaaaataaagtatgtttgcctccttaa

SEQ ID NO: 353876 - DNA, 2570 bp, Homo sapiens
cccccaatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttaaaaaaaaagggggggatggccttgttggccttagcgaga

SEQ ID NO: 353877 - DNA, 2564 bp, Homo sapiens
cccccaatgggagggctctttgatatcttcctcctcctcctccctgcgctgctccccaggagccagtggacacaagcagagggatacaaatttcgcgcgggcagcgctgaggtgggccgtaaagaggaacggaccggaagtggtggtggttatagcaaccagtgtggccagcctcttccccagcttatcctcctcccaatactcccgctctttttttatgaggctgggaaaatagaacgaggaagtggtgacgcactgggctctcacgaatacaactagaagctgcaacgactgtgtggctctatcgattcgggagaggtccagaccggaaatggtcgtttccatggtaaccctgagcaggttgcctgggagatgacctctttcgggtctctttgaatctccgctgtagcgtcacctggaaggcagatctaacagagaacctggactgtctcctatcatgattcccgggaaatatcgctctgtttctggccgggctgcgaacaacgtgaactgcgggcttcatctggttattcaaacatcatcgcttcctgaaaaaaacaaagttgaattcaagctaaataaagacacatcgtcattccccggtagacttttacaacatgaccttgaaagaaactactcaagtaggcaaggtgatcatattaatttggtgagctcatcattgtcatcatttcctattcttcaacgttcttctgaagagaaaattctttactcagacaggttgagcctagaaagacaaaagctgaccgtatgtcctatcatcaatggggaagaccaccttcgtttgttgaactttcaacacaattttataactcggatacaaaatatttctaatctacagaagttaatatcgttggatttatatgataaccagattgaagaaattagtgggctttcgactctgagatgtcttcgtgtccttctgttggggaaaaacagaatcaagaaaatctcaaatctggagaatctaaaaagcttagatgtcttggatcttcatggaaatcagattaccaaaattgaaaatattaatcatttgtgtgagttgagagttttaaatcttgccaggaactttttaagtcatgttgataatcttaatgggctggattcactaactgaacttaacttgcgacacaatcaaatcactttcgtgagagatgtggataatttgccctgcctccaacatctctttctcagctttaacaatatatctagttttgacagtgtttcctgccttgctgactcttcttccctctcggacatcacctttgatggcaatcccatagctcaagagtcatggtacaaacacactgtccttcagaatatgatgcagctgcgccagctagatatgaagagaatcacggaagaagaaaggcgtatggcatctgttttagccaaaaaagaggaagagaagaagcgggaaagtcataaacaatctttgcttaaggagaagaaaaggttaacaattaacaacgtagctcgacagtgggacttgcaacaacgagtagccaatattgctacaaatgaagatagaaaagattctgactctcctcaggacccctgtcagattgatggaagcaccctctctgcattcccagaggaaacagggcctctagactcaggactcaacaatgctttacaaggtttatctgtcatagacacataccttgttgaagtggacggggatacactttccctatatggctcaggagcactggaatctctggataggaattggagtgttcaaacagcaggaatgatcacaacagtctccttcactttcatagaatttgatgaaatcgtccaagtgcttcctaaactgaagattaagtttcctaattctctgcaccttaaattcaaggaaacaaatcttgtaatgctgcagcaatttaacgcactagcccaactccgtcgtattgaccagttgacaattgatcctcaaggaaatccagttgtcaattttacactctggaaatactatgtactgtttaggctaagccatttcagtatgcagaaaataaatggaacagaggtgacacagaatgatatgataatggctgaaaggctctttggaatcctagcacatgtagcatcttctgagttaccccagtatcgtctgatttccattctgggtgatgccaggaaaaagcaatttcggtatctactagaatccaaaggaaaaaaacctggtattatcaacgaagaaaataatgacagcaaaagacttgtaggagaaaacacaaatcgtgctacattaaattatactacaagagacttttataatgaaaagctagaggaaataaaggaaaagaagaaattctgtaaaacatatatagaagaccttgtgaaggaagccacagaaatcaacatgaaaaatgaggctttgcagaagctttggccacagatgttcattgagcttgttagggatgcagtcatagaaattcgcaataaaaattcctatatgaagctctgcctacagcagataacagaccaaaaataaaaatggcctttagttaaaaaaaagggggaaaatggcctacgtggcctca

SEQ ID NO: 353878 - DNA, 338 bp, Homo sapiens
aaaattccatttataaattccgttttcacaaaccctattacaatttcactcagaccattaatgacatgcttggactttctgctttgtcctgtatttcctttcttaaataaccattttattttaggatgaaaatttgccacataagattctttgtcatacaaaattattctatttctcaataaaggacacattttaatgcctatcttgtaattaaaaaaaatttttttaagagacagagtcttgctctgtcacccagactggagtgcagtggtgcaatcatagctcactataaccctgaactcctgggctcaagcagtcctcctgcctcagccacccca

SEQ ID NO: 353879 - DNA, 447 bp, Homo sapiens
tctcctttgcccacccacctcagcagtgttctcgcagcctatgatttgttttcactgggggccctgcttcaggaaagacacctaatgataaggctgagtcatgggtcagttatggtggatggagccagaagactcatttcactgtgaagacaaatggacatgacacgtcagcacacacttactcctccctacggagcagtctctaaatggaaatccttccagactggctgagagagagattttttggtgaacctgtttcagttaaatgtgacatgggcaataatgaaaaattgggtgaaatgtttttaggaggcagaaattttgaagctgccccagatttcacaccatcggtctttgatttctctgcgcagttagattccagtccccagtctctagattgcattggtccagtaaggggcagccttagtccagaccaaaaaaaaaagc

SEQ ID NO: 353880 - DNA, 693 bp, Homo sapiens
tcttggctcactgcaacctccgcctctccggttcaagcgattctcctgcttcagcctctcatgtagctgggatcacatgtgtgccaccatgcccagctgatttttgtatttttagtagaggcggggtttcaccatgttggccaggctggtctcgaactcttcacctcaagtgattcactcacctcggcctcccaaagtgttgggattacaggcgtgagccactgcacccagcctaggggttttctttttgaggtgataaaaatgttctaaagtttatagtgatgatgcttgcaatttctataagtagacttaatgcagtgatggttgcaaattctataaatatatttaatgtggtgatggttgcaaattctatgaaaaacccaaattgtacaatttcaatgagtgaaagcatgctatgtgaatgtcttcataaaggttttatttaaaaaatgagcaaacggtagaatgttaacatggcccacgtctatgtggtgtctatattggtttctattatatgttttctatgtggttgaaacattcctaataaaatgtgcatagttttttaaaaaagaaaacacatcagtggacgtgaatgcaggatgtcttatgaatgctcacacagaagctcccattcgtgaggaatgcaggtgggtactttcaggtgggtacttaacaggtgggtactgcaggtgg

SEQ ID NO: 353881 - DNA, 1133 bp, Homo sapiens
tcttggctcactgcaacctccgcctctccggttcaagcgattctcctgcttcagcctctcatgtagctgggatcacatgtgtgccaccatgcccagctgatttttgtatttttagtagaggcggggtttcaccatgttggccaggctggtctcgaactcttcacctcaagtgattcactcacctcggcctcccaaagtgttgggattacaggcgtgagccactgcacccagcctaggggttttctttttgaggtgataaaaatgttctaaagtttatagtgatgatgcttgcaatttctataagtagacttaatgcagtgatggttgcaaattctataaatatatttaatgtggtgatggttgcaaattctatgaaaaacccaaattgtacaatttcaatgagtgaaagcatgctatgtgaatgtcttcataaaggttttatttaaaaaatgagcaaacggtagaatgttaacatggcccacgtctatgtggtgtctatattggtttctattatatgttttctatgtggttgaaacattcctaataaaatgtgcatagttttttaaaaaagaaaacacatcagtggacgtgaatgcaggatgtcttatgaatgctcacacagaagctcccattcgtgaggaatgcagggaaaagcagaagatggagtaggagttggcatggcccagctagctcagatgacacacgatggtcccagtggcatgacttggtttgtgtgatttgtgccttggggttttattttggcacattataaaggagtaaataaagcctgtatacagtcagtttctgtctattctaatgaagggcaaggggatgaagggatttaccttgagtaaccatccacttacatttattaggaatcttgtgatcctatcgtcacccgtgagatttctgtgttgtttgtgtttaatgtcagagaatatcttttaatcgctcatacagtttatgcaaataccgtatacgtgataaacgtccctacaacatgatctttggaatgaactaagacaaaggaaactctgaggaaggaccatggcctgagaggtggaattcatccttccgaggactgagatgaggacggaaaatgcccatctgcgctcgggatcctctagatcgcc

SEQ ID NO: 353882 - DNA, 1283 bp, Homo sapiens
gggactcgttctcgaggcgggagctgaggtgcggggtggggcctccaaccgtgcagcccgcccctgacgccgccggtaactgcgacagtcggggtcggtgcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgttttttaaaaaagaaaacacatcagtggacgtgaatgcaggatgtcttatgaatgctcacacagaagctcccattcgtgaggaatgcagggaaaagcagaagatggagtaggagttggcatggcccagctagctcagatgacacacgatggtcccagtggcatgacttggtttgtgtgatttgtgccttggggttttattttggcacattataaaggagtaaataaagcctgtatacagtcagtttctgtctattctaatgaagggcaaggggatgaagggatttaccttgagtaaccatccacttacatttattaggaatcttgtgatcctatcgtcacccgtgagatttctgtgttgtttgtgtttaatgtcagagaatatcttttaatcgctcatacagtttatgcaaataccgtatacgtgataaacgtccctacaacatgatctttggaatgaactaagacaaaggaaactctgaggaaggaccatggcctgagaggtggaattcatccttccgaggactgagatgaggacggaaaatgcccatctgcgctcgggatcctctagatcgcc

SEQ ID NO: 353883 - DNA, 1187 bp, Homo sapiens
gggactcgttctcgaggcgggagctgaggtgcggggtggggcctccaaccgtgcagcccgcccctgacgccgccggtaactgcgacagtcggggtcggtgcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctgggttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgttttttaaaaaagaaaacacatcagtggacgtgaatgcaggatgtcttatgaatgctcacacagaagctcccattcgtgaggaatgcagggaaaagcagaagatggagtaggagttggcatggcccagctagctcagatgacacacgatggtcccagtggcatgacttggtttgtgtgatttgtgccttggggttttattttggcacattataaaggagtaaataaagcctgtatacagtcagtttctgtctattctaatgaagggcaaggggatgaagggatttaccttgagtaaccatccacttacatttattaggaatcttgtgatcctatcgtcacccgtgagatttctgtgttgtttgtgtttaatgtcagagaatatcttttaatcgctcatacagtttatgcaaataccgtatacgtgataaacgtccctacaacatgatctttggaatgaactaagacaaaggaaactctgaggaaggaccatggcctgagaggtggaattcatccttccgaggactgagatgaggacggaaaatgcccatctgcgctcgggatcctctagatcgcc

SEQ ID NO: 353884 - DNA, 1094 bp, Homo sapiens
gggactcgttctcgaggcgggagctgaggtgcggggtggggcctccaaccgtgcagcccgcccctgacgccgccggtaactgcgacagtcggggtcggtgcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtgagtgacttggcccttcacctcctgactgcttgttttgagtcacatgtaaattatatttgcagagcacttcttaactattacaaagcagttgtgcttgtgttttcatttgatctctctggtaatactgaaaaccagtttggacagttgtcattatatccattttataaatggggtagtgaagacattctagaattaagtctgagataagttacttaggtgaagaaattttattttttcacattgctagaagaaacatgctagatactagaaacatgctagaagaaaacttggatgaaataatctttaacctggtatagggagaggctttctaattctaaatccagagccagtaaaggattaataaataatgtctacaaatacca

SEQ ID NO: 353885 - DNA, 904 bp, Homo sapiens
gggactcgttctcgaggcgggagctgaggtgcggggtggggcctccaaccgtgcagcccgcccctgacgccgccggtaactgcgacagtcggggtcggtgcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgtttatgcaaataccgtatacgtgataaacgtccctacaacatgatctttggaatgaactaagacaaaggaaactctgaggaaggaccatggcctgagaggtggaattcatccttccgaggactgagatgaggacggaaaatgggggattgacggtgaagatgctaatacctgcccagcatcgaccctagtgcgggt

SEQ ID NO: 353886 - DNA, 470 bp, Homo sapiens
gtatttaatgtttcaaagtattattctgttttgggggcagtacaatgaattagagctaatgcatttagaaaatatgaattacaggtaattgagggatcagattataaaactaacctttgctttggtttcttctccagggcctgctctcttttttgagtgccccactcattggtgccctgtctgatgtgtgggggaggaagccctttctcctcggcactgtattctttacctgcttcccaatcccactgatgaggatcagcccatggtgagtgacttggcccttcacctcctgactgcttgttttgagtcacatgtaaattatatttgcagagcacttcttaactattacaaagcagttgtgcttgtgttttcatttgatctctctggtaatactgaaaaccagtttggacagttgtcattatatccattttataaatggggtagtgaagacattctagaattaagtctga

SEQ ID NO: 353887 - DNA, 849 bp, Homo sapiens
gggactcgttctcgaggcgggagctgaggtgcggggtggggcctccaaccgtgcagcccgcccctgacgccgccggtaactgcgacagtcggggtcggtgcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgccgggtgtggtggcgtgcacctgtagtcccagctacctgtggcaggagaatggcttgaacccaggaagcggaggttgcagtgagccaagatcacaccattgcactccagcctaggcatggtgagactccatctcaaaaaaa

SEQ ID NO: 353888 - DNA, 1360 bp, Homo sapiens
gggactcgttctcgaggcgggagctgaggtgcggggtggggcctccaaccgtgcagcccgcccctgacgccgccggtaactgcgacagtcggggtcggtgcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggagtctcactttggttgcccaggctggagtgcggtggcgtgatcttggctcattgcagccttgacctcctgggagcagctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatgttttttaaaaaagaaaacacatcagtggacgtgaatgcaggatgtcttatgaatgctcacacagaagctcccattcgtgaggaatgcagggaaaagcagaagatggagtaggagttggcatggcccagctagctcagatgacacacgatggtcccagtggcatgacttggtttgtgtgatttgtgccttggggttttattttggcacattataaaggagtaaataaagcctgtatacagtcagtttctgtctattctaatgaagggcaaggggatgaagggatttaccttgagtaaccatccacttacatttattaggaatcttgtgatcctatcgtcacccgtgagatttctgtgttgtttgtgtttaatgtcagagaatatcttttaatcgctcatacagtttatgcaaataccgtatacgtgataaacgtccctacaacatgatctttggaatgaactaagacaaaggaaactctgaggaaggaccatggcctgagaggtggaattcatccttccgaggactgagatgaggacggaaaatgcccatctgcgctcgggatcctctagatcgcc

SEQ ID NO: 353889 - DNA, 847 bp, Homo sapiens
gggactcgttctcgaggcgggagctgaggtgcggggtggggcctccaaccgtgcagcccgcccctgacgccgccggtaactgcgacagtcggggtcggtgcggtttgctaagtggtcggttcctggagctgcggtcttctgctagcctgatccgcagcttcagcctccgccgcctcctcagccctcggcgccgccgcctgacccgcaggccgccgcgggccgcagagcccatgagggcgcgggcaccgccgccgcctccgcggcgtcgccgtcgtcccggagcgccccgagctggcgcgggcatggccgcggcatgagcgtggagccgccgccggagctggaggagaaggcggcgtcggagcccgaggcgggagccatgccggagaagcgcgcgggcgcgcaggccgcggggagcacctggctacaaggctttggcccaccaagtgtgtaccatgctgctattgtcatcttccttgaattctttgcgtggggccttttgacaactccaatgttgactgttctacatgaaacattttctcaacacacattcctcatgaatggtctcattcaaggtgtaaagggcctgctctcttttttgagtgccccactcattggtgccctgtctgatgtgtgggggaggaagccctttctcctcggcactgtattctttacctgcttcccaatcccactgatgaggatcagcccatggtattttgcgatgatttctgtgtctggagtcttctcggtcacgttttctgttatatttgcctatatagctgatgtcactcaggagcacgagcgaagtacagcttatggatgggtctcagccacctttgcggctagtctt

SEQ ID NO: 353890 - DNA, 720 bp, Homo sapiens
ggcgtgtcatgtggtactttaggtagcttcacattttatgttctagttaagtaaaattcttagagaatgaggtactatctctggatagtctgtttgatcttgaaaatgtacagaattctttgcctcttgatcctggaggactagtgactttccagctctgagagagaacaggatccctctgccaatttttttctgtggtgtaaggcagagcctggtcactccatctaatgctgtctatctcatctcacgtataggagcgggatgctgcactccaaccctggggactatgcctggggtcagacagggcttgatgccattgtaacccaggtgaggagctgccttttgagggtgtctgttcagtgtgtctcatggttccacaggcttcctgctttccttctgctactttctgaaatggcagtcactctgctttctctaatattttgagctttggggtttccattttactaaagggatgaatgatttatggggttagctcagcatccatgcacttcctaggtctgagggaatttctagaagatggtttcacctccataggaagaaaagacttctataacaaatagtattttgtatttttgtctctcttgctcagttctataaggattctattaacaaatatttcacaaaaaaaggagggtttcctcacatgttgaagcagggatttctgctagatggagcaaagtaggggaaggaagcagagaa

SEQ ID NO: 353891 - DNA, 670 bp, Homo sapiens
ttggtttttcatttccgttgtggatttctgagactagaaagcatgtcctttatattcagtcgtcttataggcagtaatttacctatttcttggctcacgttatgctacttttcatactctcgcttttttcttcttccagaagatgaagcttttggaccagttacattttactttttattaagctatagttttactcgtgacaccacaacccttttgctgcctctgaagttgctttatgcctagaggtgggccttgcaatcatgggtttgtctgtaggcttatacgaacgtcactctgaaattgtaaagcaattatgagtgttctggcagcaggaaaggggaaacccaagcctctcagagccttgcagaagtaagagtaactaacatacctaatgtctgcactgtttgttctcagctggagcagttccctctccagggatattgcgatgtctgccacttcgtctttttctttctctttttttgtagcttttaggacaactggaaaacacaggccctcccccagctgacaaggaaaagatcacatctcttccaacagtgacagtaactcaggaacaagttggttcctcatcccagtgacgtcctcatcccagtgacgttcctcatccggatgatggaacgtcactgaactgtttgctacaaatgaaaatggg

SEQ ID NO: 353892 - DNA, 1602 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtattta

SEQ ID NO: 353893 - DNA, 1555 bp, Homo sapiens
tgtttgtggagccggcgggcgggccgtttgtctctccttcctgcgcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccgttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtattta

SEQ ID NO: 353894 - DNA, 1793 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagagagagcgagagtgagagagagagagtgagtgcatgagcttgcacaagagagggcagaagaatgggagaggaaaaagaaagaaaaatgggaaaatttggaaagtgatatcatagcagatgtggtgatacgcactgctcctgattgtatgtggcattccatgtacatctgtacgcatgtcagagtaaatctgttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtattta

SEQ ID NO: 353895 - DNA, 1865 bp, Homo sapiens
ttttggcataggaccgaaacatgcattttaattaaacattcgtaatttttcttacacagcaaaaccaaaagccccacaatggaaaatcattttctgttcactgattgttaaaaactttttttaaaaaaagtcctgtgacatcaagtgcttgccaggatgtggcacagtagaaactcttaaacacttggtgggtgtttaaattgctacaaccagtttggaaaacaatttgtcattacccagtaaagttgaagatgtatagatcatgtaatagttttacagaccaaaaatatagaaactctggtacctctgcagaagaagacatacagtaatattcacagtggccatttgtaatataaaaaactgtaaacaatccaggtgtttattgattgatttttctaacatgtgacttatttctggtctttactagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttgttttttttttttgagatggagtctcgctctgtcgcctaggctggagtgcagtggcacgatcttggctcattgcaaactctgcctcctgagttcaagcgattctcctacctcagc

SEQ ID NO: 353896 - DNA, 1411 bp, Homo sapiens
ggcgtgtcatgtggtactttaggtagcttcacattttatgttctagttaagtaaaattcttagagaatgaggtactatctctggatagtctgtttgatcttgaaaatgtacagaattctttgcctcttgatcctggaggactagtgactttccagctctgagagagaacaggatccctctgccaatttttttctgtggtgtaaggcagagcctggtcactccatctaatgctgtctatctcatctcacgtataggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttgttttttttttttgagatggagtctcgctctgtcgcctaggctggagtgcagtggcacgatcttggctcattgcaaactctgcctcctgagttcaagcgattctcctacctcagc

SEQ ID NO: 353897 - DNA, 1569 bp, Homo sapiens
ttggtttttcatttccgttgtggatttctgagactagaaagcatgtcctttatattcagtcgtcttataggcagtaatttacctatttcttggctcacgttatgctacttttcatactctcgcttttttcttcttccagaagatgaagcttttggaccagttacattttactttttattaagctatagttttactcgtgacaccacaacccttttgctgcctctgaagttgctttatgcctagaggtgggccttgcaatcatgggtttgtctgtaggcttatacgaacgtcactctgaaattgtaaagcaattatgagtgttctggcagcaggaaaggggaaacccaagcctctcagagccttgcagaagtaagagtaactaacatacctaatgtctgcactgtttgttctcagctggagcagttccctctccagggatattgcgatgtctgccacttcgtctttttctttctctttttttgtagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttgttttttttttttgagatggagtctcgctctgtcgcctaggctggagtgcagtggcacgatcttggctcattgcaaactctgcctcctgagttcaagcgattctcctacctcagc

SEQ ID NO: 353898 - DNA, 1229 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgccatgttcctgtatgtacggaagactttccatggggaggactcttccttcgggaaagccaggagcctggggctcttgtaggcaccgattagcatcgcggcgtctctggccgaggctcctggagtcaggaccacctgacaggtggggtaccctcctgttggctgttcaccaactgtacggtgcgctttgccccccttatgcgagttcc

SEQ ID NO: 353899 - DNA, 973 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttggaagttaatccgggagcactttgtttggggttaaaggttgccctttatgcgtttcccagttggtcgg

SEQ ID NO: 353900 - DNA, 615 bp, Homo sapiens
acgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggtaagagcgctgtgttctctatacttgggaacctcatagattcctggccccgatttcccggaactgggtctggagctttctgcacatcattgactcgcccgacatcggtctgccgaatacctgctgcccacttctaagccgccggccctaaaccctgggcatcacggcctcggccccgtacctcctgcccacctcttaattcatcctgggctgctccacctgacctcacctctttacctcccgtgtccttaatttttttttttcttagcaagtttccctctgataactctcccctcaattttcttgcattcttttatacctggtctttttcctacgatgacctccccccacacttcttccactgtgtcttctcaccttcctctgtgt

SEQ ID NO: 353901 - DNA, 1896 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttgttttttttttttgagatggagtctcgctctgtcgcctaggctggagtgcagtggcacgatcttggctcattgcaaactctgcctcctgagttcaagcgattctcctacctcagc

SEQ ID NO: 353902 - DNA, 1654 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagaatctaaagttgaaggtcccttccacaaccaggaaaaactacacattttacattttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtattta

SEQ ID NO: 353903 - DNA, 1278 bp, Homo sapiens
ataaattattttgtctttctagtagagtgatgggactcaaggttaacatgactctcttattaaaccaccgatccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtattta

SEQ ID NO: 353904 - DNA, 1665 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagaatctaaagttgaaggtcccttccacaaccaggaaaaactacacattttacattttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaaactactcttgatcacattagctatgaggcgaggtcaaattcaggtatctaagactaatgattttgttttgtcttgatccccagagagcaaatcaaagaaaaattacagcaagaagagaaaagtggtttatcattgtgtgctttggttttcttattttaattttttgttttttttttttgagatggagtctcgctctgtcgcctaggctggagtgcagtggcacgatcttggctcattgcaaactctgcctcctgagttcaagcgattctcctacctcagc

SEQ ID NO: 353905 - DNA, 1122 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatggctttagagtgtccaggagagaatgtgttctctctctgggctccagccctgatggggtggggataagatccaagatttataggaatagggggaaacattatggaaggccccaatatgtaatgagctttcatatacaagatatgcaagacatagccctctttttatgtttaaaggggactatgtaatgttttaaagtttgtgtgaaggtgtg

SEQ ID NO: 353906 - DNA, 1205 bp, Homo sapiens
gcaggctggtactgcgtccgaagttcgtatgatcctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccaggtgaggagctgccttttgagggtgtctgttcagtgtgtctcatggttccacaggcttcctgctttccttctgctactttctgaaatggcagtcactctgctttctctaatattttgagctttggggtttccattttactaaagggatgaatgatttatggggttagctcagcatccatgcacttcctaggtctgagggaatttctagaagatggtttcacctccataggaagaaaagacttctataacaaatagtattttgtatttttgtctctcttgctcagttctataaggattctattaacaaatatttcacaaaaaaaggagggtttcctcacatgttgaagcagggatttctgctagatggagcaaagtaggggaaggaagcagagaa

SEQ ID NO: 353907 - DNA, 703 bp, Homo sapiens
aaacattcctgctttttatttgcattttcttgttttggcccagccacaaaaggcggtttccacaccattgcttttgactctggaggagcagggacgggaggacttggccacagccctgcggcccccaccctgggacatggcttatcagagcaggcggtggcttctgctttctctggaaatcagcagctcctgtttggggagtttgtgcaaatgctggcttgtcagcactctttcaaatcaggaaaccacgctttccgaccagcttgtgtgttgatcttggcaggaattctgacgaatggaaaaaagaaggctgttcctcgaaggtcacgtcaggggctatttctggccacagggcctgggctcctcatgatctcacctctttgcaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctcgggacctcgggatcctgccctccaggcccaacaaaggttactgggactttttttctcacatggttgcatgactctaaaatgtcgcgttgaatctcagcatgatgggacatctgttgaggaagtcttcctgggtatctggccaagtctattcccttctc

SEQ ID NO: 353908 - DNA, 809 bp, Homo sapiens
atcagtgccctacagaaaggctacagcaaggtgctgtgccagaccctgtcagagcggaactcagaaatcacatccctgaagaatgagggcgagaacttaaagagagacaacgctatcacatcagggatggtgtcatctttgcaaaaagacatattagcaaaggatgagcaagttcaacaactaaaggaagaggtcagtcacctaaaaagtcagaacaaggacaaggaccaccagctggaagcccttggctctagactggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctcgggacctcgggatcctgccctccaggcccaacaaaggttactgggactttttttctcacatggttgcatgactctaaaatgtcgcgttgaatctcagcatgatgggacatctgttgaggaagtcttcctgggtatctggccaagtctattcccttctc

SEQ ID NO: 353909 - DNA, 797 bp, Homo sapiens
ctgaccacaggcatcgttcgggttaggcaggcgtgcctaaaaagtaattaaagcctgctgttctcttttcttctgtgggtcccgccactccccgtgagcggtgaagattctgataacgcggaatggtcattcaggcgtgcaaaccctgctaagtggtgtttcccgcaccctgccatggaaacgctgcccccacttgccggcccctgctgaccccctgacactgttgccccctctctgctgcagctggagcacttcagaagtcaagtcatcaaggccacctatggacgggcgaagccgttccgggacaagcccgtcaccgaccaacagttaatagagaaaattacccaggtcactgaggacaacatcaattttcagcagaaaaagtggaccctccagaaagagacccagctgagcaactccaagcaggaggagaccaccgagaacatcgagaagctgaggacgtcgctggacagctgccaggcttgcatgaaaatatcctgttgcagccatgacctgaagaaggaggtcgaccttcttcagcacctccaggtgagcccacctgtctcggggctccagaaggtggtgctggacgtcctgaggcacgcgctgtcctggctggaggaggtggagcagctcctcgggacctcgggatcctgccctccaggcccaacaaaggttactgggactttttttctcacatggttgcatgactctaaaatgtcgcgttgaatctcagcatgatgggacatctgttgaggaagtcttcctgggtatctggccaagtctattcccttctc

SEQ ID NO: 353910 - DNA, 1733 bp, Homo sapiens
gttcacttaaaattcatagagagacatgtagaaatacatactagataatgaaaggatccaaacagtgaagaagcagtccctttatatttttgaattttttttcaagagtaaagtgtgttatgatagtcatcttgatttgtttgaaatgatgtttacaaatgctattaaaattataaatcctacattttacttgtgaattttttggtctacctttctagttgtaaaatataaaaatcctaaaagatcatattgattaacttcttggtggaatcacttatcttgttttgatgatagggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgcc

SEQ ID NO: 353911 - DNA, 2860 bp, Homo sapiens
acctctctctagagcactgagaaatactttttaaggagaggtttctcatcagaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353912 - DNA, 3297 bp, Homo sapiens
agctccactttatcgaggagccggtggtaggtggcccgcaggcctcgggcaccggcggccgacatcgccgccgagggatcgttggcagccgggtgggagcgtggctgtgttctcgtccctggctgacaacgaaggggagctagtcacttttcctgccacgacgactcgcgtccgcctctcgcctggagtacccttcccgcggctttccctgcccgctgtgaaccgaaaagctgcggcccgcgccccgcgaaggttgagggggcggaggctgccgactgccagcccccggtccgcctccggcccccggcaggagagagggaggagccatggcaacaggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353913 - DNA, 3459 bp, Homo sapiens
gtgaccaccggtgctcacagcccctgtcacgtaccccctggcttactcaatcgatcacgaccctctcatgcggacccccttagagttgtgagcccttaaaagggacagaagttgagcatcagacgagctcggattttgagacgctagcctgccgattctcccagctgattaaagccactcccttcactatctcggtgtctgaggggttttgtctgcggctcatcctgctacatttcttggttccctgaccgggaagcaaggtgattaacagatggtcgaggcagctccttaggcggctttagcctgccctgtggaacatccctgctggggactccaaccagccagagtgacgcggatcctgagagctctcctgggtaggcatttgccccggtgggacacctcgccagagcagtgtgtggcaggcccccgtggaggatcaacagagtggctgaacaccgggaaggaattggcacttggagtccggacaactaaaacttggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353914 - DNA, 2916 bp, Homo sapiens
acctctctctagagcactgagaaatactttttaaggagaggtttctcatcagaggttatatagtgatgtttgaatgggcctggctggctgtttgaagctggatcttacaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353915 - DNA, 3556 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353916 - DNA, 3321 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgcc

SEQ ID NO: 353917 - DNA, 1680 bp, Homo sapiens
cttgtgctgtggttgttaattacatggtccggttctttgttaatttgacagagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353918 - DNA, 3120 bp, Homo sapiens
  misc_feature (2981)..(2981): n is a, c, g, or t
  misc_feature (2985)..(2985): n is a, c, g, or t
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttancttnagagcttcagaattacgggttgggtggaggtcctctctgggaaccacatgggggcagactcggtcgctcgggaggtccaacccccagtgtcacctgcggtgaggggcaaaagacgtcccacgagggggccacaac

SEQ ID NO: 353919 - DNA, 2929 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagc

SEQ ID NO: 353920 - DNA, 1797 bp, Homo sapiens
gttcacttaaaattcatagagagacatgtagaaatacatactagataatgaaaggatccaaacagtgaagaagcagtccctttatatttttgaattttttttcaagagtaaagtgtgttatgatagtcatcttgatttgtttgaaatgatgtttacaaatgctattaaaattataaatcctacattttacttgtgaattttttggtctacctttctagttgtaaaatataaaaatcctaaaagatcatattgattaacttcttggtggaatcacttatcttgttttgatgatagggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353921 - DNA, 2880 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagc

SEQ ID NO: 353922 - DNA, 1481 bp, Homo sapiens
attattctttttacctaaagtagtctgtttttggaacatctttaaaccacattttaaataaaatatcaaaatagaagtctatccactgctattatatattacctttagtttcttttcatttctctttatgtgttttcttaatatggagaagaggggaaagaacattggataaaatttgttatatttgtagtaaaattgcacatgaattttgtctgtattatgtttttataaaatagccctttaaaaaccagtttgccgcatgctattgcctttacttttcatccagtaccaaatttctaagtgatctcttaactaaaatactttgttgtagtaactcaactagtctgacttctcactgttgtgtctgcgtttttatgcttttggttgggggtgccttattgagatagtgtgtttatgtatttcctagacttactatattttcataagtttctcattattctttgtgaatatttttatttatttttgtttttttaatatgtaattcatataacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353923 - DNA, 2010 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaagctcctgaagaatcatcagaggatgcgacactatcagggagtatctgcgagttgctcagaactcatgacg

SEQ ID NO: 353924 - DNA, 771 bp, Homo sapiens
ttaaatacaagttacagtgattatttggcattgaatagacttaaggcagaaatatagacatcagacgcataaagaatgaagtaattcctcctggtactggctgattgtttacggtttgcctgatcttcaaggaaaaaatacagttactttatgatctttgatacgatttttaacttgccttgtaggttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353925 - DNA, 351 bp, Homo sapiens
tgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagaggtaggtttactcaaaaccatgtcctttggccgggcgcggtggctcacgcctgtaatcccagcgctttgggaggccgaggtgggtggatcacctgcggttgggagtttgcaaccagcctgaccaacatggagaaaccccgtctttactaaaaacacaaaattagctgagcg

SEQ ID NO: 353926 - DNA, 483 bp, Homo sapiens
gacatcatctcccacagaaagccctcattctactcctttgctatcttctccagacagtgaacaaaggcagtctgttgaggcatctggacaccacacacatcatcagtctggtgaggataagtatgctgtggttcatctaatgatttttgatagtgaaaatttctttactggctattttgaaagatactaaatcacatcaacttcttgttggaataaatgatcaaaatgacatgtaatatatggttatgtaacttaaacacaaaaattaattatgtcttacttgcatgaattttaacaaatagcaggaatcttcaatttatataaaacaattgttttaaaagtacaagtaccaaaagatagtgttttgacatagtttaatgtgcctgacttaaatattattttatagattattagagaccaaaatatctttctagatttatttggttttatgtctatattaaagtgattatgaaaatatcagta

SEQ ID NO: 353927 - DNA, 234 bp, Homo sapiens
attctcttatctgtgtttccagaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttgg

SEQ ID NO: 353928 - DNA, 463 bp, Homo sapiens
cgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggtgagcgggggccccggggcggaggcgctgaggtcgccgcctagagtgggggagggggcacgctgccgggtctgttggaggtgggacggcgtctcggtgggggcgcccggagactctggggtgttgggtggggccttggttgccgaattccgtgccggtgcctcccccagtcaagccccctgtgcatgctgccagccgccgcccttgctgggtttttctcggagggccgggccgtgggcagaaggtactggcttgtaaaggtgttggggtcgctgatgggttgggactcgggagact

SEQ ID NO: 353929 - DNA, 2450 bp, Homo sapiens
aaagaattcggcacgagtaaggagaggtttctcatcagaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagc

SEQ ID NO: 353930 - DNA, 3385 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353931 - DNA, 3065 bp, Homo sapiens
tgccgaattccgtgccggtgcctcccccagtcaagccccctgtgcatgctgccagccgccgcccttgctgggtttttctcggagggccgggccgtgggcagaaggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353932 - DNA, 3325 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353933 - DNA, 3207 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353934 - DNA, 1963 bp, Homo sapiens
gccctgctagagagactaggagatttggggctgcggccgtttcctccggagcacccacgggactgtgtgctggggtccctccaccggctgtgtcctttattcttctttctcacccaacgatttacctgaacggttataaagtgcacgttatttccctaaggtcccctgaagtcatgggttgctggctcctgctcagagtgacagcaccctgtggagtctgctggtactgacctaaccaccacagagccccactggagcatggagccagcctagagagggtcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353935 - DNA, 3025 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacaaccaggttgcagtagcagtggatgttagcgtgagcgcattagg

SEQ ID NO: 353936 - DNA, 1333 bp, Homo sapiens
accacctgttacatacaactttattttctgacagcacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaaaaaaaat

SEQ ID NO: 353937 - DNA, 2701 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatggtaccaaatgttcatggcattttttggtgaaattgcagtttcatgctctgagtgtttttccataatgatttatcttcatatattgccaatgggatttcagtattacattattaaatcttcagttatctctttatccaacatggttcttttagccctataatatattgtgaaagatcattattttttacaagaaaactctactaaaaaa

SEQ ID NO: 353938 - DNA, 2992 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgataggttggtaaatttttaattaacatgaactgtaaaaaatgtatttcacaaggatttgtttgaagtcattgaagggaatctctccatttttgacagttgcttcctctaagagtgtctcattcatataaacttaaagaaactttacagtttactgtaaatgattttacgtattatattctttgagcactgtgcattaatagggaaataaaaagtcttcattctccatatctctagcactgaggcttgcttctgaatttacagatcaagagaaaagaatgttaagaatgacccacaggttatttatgaagtcaaggttatacttagctctcagattatcttgtagatatccaggcctttatcagtgttgttttggttttaatgttaattttttctgcttttctattgaccctggattaaggtagtgtgttagtagttctgtttttgggaacactgtttttctttgatttctactaaacttagtgactgaatttagaaaatgaaaaattataccaaataaataccatagcagcaataaaaaattgaattgccaacatgtttttatagtttttctatattttatgtgatcacaaggatatattttcttttgtgggagttaaaataaatttttaaagtatactgca

SEQ ID NO: 353939 - DNA, 2299 bp, Homo sapiens
agggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcaggtcccctgaagtcatgggttgctggctcctgctcagagtgacagcaccctgtggagtctgctggtactgacctaaccaccacagagccccactggagcatggagccagcctagagagggtcaggtaggaactgttttttcactttatggcacggttttaccaattggaaaaaagtaatttttataccccaaaagggtgtaaaacattggtgattatttttgaaaaagggcttttcaaaactgagccatattggaaaaaatcagcacttacccgatcctgtgcaagcaggctctaaacaacaccagatttcccacagtgtccataatgacagtcacatggcagcacttctcagatggatgcattggatctatgtgtttgatgtttataagtagttaataaattagatatattagtctggttctg

SEQ ID NO: 353940 - DNA, 487 bp, Homo sapiens
cagctttattttcacactgtaaatatcaatattgtataaacttgtcattattgggactaatcagcaaattgttttgtgtcatgctagagatagcaaggtacaaacctttctattaattaatgaagtaatttttaccaaagacattaaatatgggtggaccaaaagtgtatagtctagcacttctataaacatagtgtctgggaggagcttgagagatttgtaatgttacttgtaaacagaccgtgtggggaagaccgcagacagcacatcattttttgtctttattggtctttatgactaacacttcatctctgcatcacttctgctttgctgtaaaacttagcaagtacattaggatagtggcaaataaagattaagattgaggacagatgtttgtaaaataactgggcgattttaagattataggtgtaacttgttaagaagaagataactggtgtggaaataaaatctggcagccaaaaaaaaa

SEQ ID NO: 353941 - DNA, 440 bp, Homo sapiens
cagctttattttcacactgtaaatatcaatattgtataaacttgtcattattgggactaatcagcaaattgttttgtgtcatgctagagatagcaaggtacaaacctttctattaattaatgaagtaatttttaccaaagacattaaatatgggtggaccaaaagtgtatagtctagcacttctataaacatagtgtctgggaggagcttgagagatttgtaatgttacttgtaaacagaccgtgtggggaagaccgcagacagcacatcattttttgtctttattggtctttatgactaacacttcatctctgcatcacttctgctttgctgtaaaacttagcaagtacattaggatagtggcaaataaagattaagattgaggacagatgtttgtaaaataactgggcgattagggttagtgatcctctagcacctcc

SEQ ID NO: 353942 - DNA, 304 bp, Homo sapiens
ctgaattcttaggtggcaacaattaaccagagctgctccctcccagtacaccatcccattctatgctccttctctgattctaagctagagtatttgtttccatctatcatcatgtttttctattgtttttcttgtaatagaaaaatattctatctctatcaagtatttgatctctacctaaaataaaaatagatggctagagctgcctgtttcttacacctggcccactaaggcatttcagccacctgccagaaggcatagaatttgaacagacactcagatgtatgcttcctaaatctgtttg

SEQ ID NO: 353943 - DNA, 319 bp, Homo sapiens
tgtacagtcactcacctgtggtccagagagggagctaagggttggatggagaggtgagggctgtcttcaaaggggcttagatatccccactggtagaagcaaaatggttctagcatgttcccagcaccagagatatgtacttggtccaatgggagttgagttttaaccagcagagtacagtaagcccagtttcttcctcaggaatgtttctggttccatctattgatctcaccatactgggggtataatgttctttctttttaaaaaatttctgtctcgcaatcctttccttagtactctctggaagggatttttactt

SEQ ID NO: 353944 - DNA, 1151 bp, Homo sapiens
gccttcgaggagaatccaggggtagctggagagcagggcgtgtgcggagagcagggcacagtgaggctggggaaggggaagtgaatttaatgagaaacttggggttgtgagtgggggaaggatttgggtgtgggatgaaggtgcaggacagggctgggccgggccattggactcaggtatgcctaggcttggggtggagcttcaaggcagcgcgggctccagcccctggaagagccaccccccacccacctgagatttcccaaattccagctgccgctctagttgcttctgcaagcaaaggagcccttgtggtcagaggggcctctgaagcctgggccaggctctcccgccctctcagggcacacacacctccattcagcccaagccccgccctttgggggggctgggggccagggcgggctgcccccacgtcagtcgtcagttgggggccacctgacccaaaggctgggcgggcagtggggttgataagacctggaccccactggtcccacaaccgtgccggctgctgcccgtgctgccagaactatgagggtcctctctggcactagcctcatgctctgcagcctgctgctgctgctccaggccctgtgcagccctggcctcgccccccagtccagaggtgagggggcttgcgtgagatgggggctactgagctagtgggccctgaccctcagcactgggggctgggtaccgatatggcagggagcacacgggatccaggatggggaagggagcagggcggcagtggtgggcagtgggctggtgcaggagcagacagggaccatggtgcttataagggtcagggcaggggtgctcctcagccctcagggaccatgcatgaggcagggaccttggtcttccaggtctctggggagcagaagctactcagagagctggctgacgtctggagctgcaccaagcccagggctgagcccatggctctttgatgacagcagacctgggatgccaagagctcatgccccctttgcaggtccttccagccttgggctccctgggggcaataacaccccccagagtttcaggtttgggcactgagtcctggaatgcccattcttcctgtacagatggggaaactgaggtcagtgagggcctaagaccacacagtgaga

SEQ ID NO: 353945 - DNA, 4340 bp, Homo sapiens
  misc_feature (4339)..(4339): n is a, c, g, or t
gccttcgaggagaatccaggggtagctggagagcagggcgtgtgcggagagcagggcacagtgaggctggggaaggggaagtgaatttaatgagaaacttggggttgtgagtgggggaaggatttgggtgtgggatgaaggtgcaggacagggctgggccgggccattggactcaggtatgcctaggcttggggtggagcttcaaggcagcgcgggctccagcccctggaagagccaccccccacccacctgagatttcccaaattccagctgccgctctagttgcttctgcaagcaaaggagcccttgtggtcagaggggcctctgaagcctgggccaggctctcccgccctctcagggcacacacacctccattcagcccaagccccgccctttgggggggctgggggccagggcgggctgcccccacgtcagtcgtcagttgggggccacctgacccaaaggctgggcgggcagtggggttgataagacctggaccccactggtcccacaaccgtgccggctgctgcccgtgctgccagaactatgagggtcctctctggcactagcctcatgctctgcagcctgctgctgctgctccaggccctgtgcagccctggcctcgccccccagtccagaggccatctctgccggacgcggcccacagacctggtgtttgttgtcgacagctctcgcagcgttcggcctgttgaatttgagaaagtgaaggtattcctgtcccaggtcatcgagtcgctggacgtggggcccaatgccacccgggtgggcatggtcaactatgccagcaccgtgaagcaggagttctcgctgcgggctcatgtctccaaggccgcactgctgcaggctgtgcgccgtatccagccgctgtccacaggcaccatgaccggcctggccatccagttcgctatcaccaaagccttcggcgatgcagagggtggtcgttccaggtcccctgacatcagcaaggtggtcatcgtggtgacagacgggaggccccaggacagcgtgcaggacgtgtctgcgcgggcccgggccagcggcgtcgagctgttcgccatcggagtgggcagcgtggacaaggccacgctgcggcagatcgccagcgagccgcaggacgaacacgtcgattacgtggagagctacagcgtcatcgagaagctgtccaggaagttccaggaggccttctgcgtggtgtcagacctgtgcgccacaggggaccatgactgtgagcaggtgtgcatcagctcccccggttcctacacctgcgcctgccacgagggcttcactctgaacagcgacggcaagacctgcaatgtctgcagtggtggtggtggcagctcggccactgacctggtcttcctcattgacggatccaagagtgtgaggccagagaactttgagctggtgaagaagttcatcagtcagatcgtggatacgctggacgtgtcagacaagctggcccaggtggggctggtgcagtactcaagctctgtgcgccaggagttccccctgggtcgcttccacaccaagaaggacatcaaggcggctgtgcggaatatgtcctacatggagaagggcacaatgaccggggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggagggggtgtgtctgggtgtgcctattgagagcgtgtaatggcgtttgggagctcgtgtgtgtatgtgtgcgtgtgtgtatgcgtgcatgtgtgtgtgtgtgtgtgtgtgcacgtgcgcctgagggtgggcatgagtcttgccagaatgtgagtgtgagagtgataatgcaggggtgagtgtgagagggactgcgtttgcatttttataatcaaaagcttaatatattcccatctttttttagttaaccctttcttgactctgagtgctgtgaatttctttactgatttctctattctccggtgagaaacaattaaatgtgatttaacgtaagcagtgaatggggctagaggcagtgtggttatttggggaccagggaaaaggatggatgaagatgtggtgggaggggatggttggaaggatggtaacagtggtggtgacagtgatgacagtgaccacaccaaaaccagctggtgtttgtcctgccttttcagttacatattcatttagttgacctcatttcacttccagtaaccttacccagaaaagactcaaattatccccattacaaatgggaaagctgagagtctaaatgatgaaatgacttgctcagcagtgggtcgctgagagacaggacttgaatctaggactgaagaacatcaaaagaaaaaggcttcagagaaaaagggcaatgacaccagataggactcatttgttcattcattcattcgttcactcattcgttcaggtatcatgtacttacagggcaatggcggtgggggggatggtgctgtatgagacagacgtagttcctgccctaagagacatacagttgagcagggtgctcatgtcacccccaccagccagagggaccagccagaggaaaagagagtgggtttaggtcgtaccaggggtttgtgcctcctcttgatacctgggagccacggggtgagtgtgtgtgtgagatgatgggaagggctccagcctgggcctgggctgccctaggtgcctctcccctcccgcccccaacatgccctgttggagttctgtttgtttcctgtgcacaggcggcatcacccccaacccaaagtccccaacgcagatgcagcagccccacctcagagactgcacaagagaaagactcctggccccatgttcccttcctccagccctatgtggggtctgcaggtcacaccctgagatctcggtcacctcccccaggcccctattggaccagtgctgctccggaatctccatctctgtcctctcagagggggagctttggtgattttctgaacctattcttgtttaatggagcatttttagtgttactactagattcacacttgagagcatgtctaaaaggcttttacaagaagctcagaccacaccgaaagatcttcctcggaggcagttcaaagaggcagaataacaacacgaacggtacccaagagccacatcagtacaacagcacaactacacaagcgcgacttaactggggcacagccaccctcgcccccatgacctgactccacctcctacacagttcaccaagccctttctctctgtctgtccctggggcagcagtttttctgctgtccaaggaggctccttgacacagccacctgagaagttatgactctgctcattcttcctttcttctgagattatccactcccctctcctccccacacaggtggggagggggagaggcagccatgttgatatggactgagaaggctcagcagtgtgtccccaaggaggaggagagggtcattagcagacgccatggcctgggagctggtgggcagaagcaacagatgtccctgatgagtggagtcagagatggggtggaagccctgcctgggaataggacctcgttcttccctgcccggtgggtggagtagtggcaggaccttgtcaccaggctctgatgaaggcagggaccagcttcttgggatcttttaatcccaaactcttgcccttcactcatcgcagttctccccacggctactccaggtcctcttgaaatccgtcctctccatggacttcccacatccctctctgctctaggtttgattaacagaaggttgtaaatgaaaaccagcatctccctagggcagccatggtctactgacagatggcaagttactttgtaacctgtaattttgtttttttgaattttgtataaataaacaggactaaactaana

SEQ ID NO: 353946 - DNA, 3639 bp, Homo sapiens
  misc_feature (3638)..(3638): n is a, c, g, or t
catggccctgaccttagagaccccaatttggcgatggggcatcacatccctccgggcatctcagagctgcctgcccgagggaggcgaacagatggaaagccccccagccacgtctctcagtcagaggaaacgggtctcctcttcggccagccgggtcctcttcccccgggtgccgcctggctgtgcgacccggcagtcctcccgcctctccgggcctcagcctcctctcctggacagtcccgtgggcttccgggagcccggtgtcacaccgccccgcgtgtcgcaggtggtcatcgtggtgacagacgggaggccccaggacagcgtgcaggacgtgtctgcgcgggcccgggccagcggcgtcgagctgttcgccatcggagtgggcagcgtggacaaggccacgctgcggcagatcgccagcgagccgcaggacgaacacgtcgattacgtggagagctacagcgtcatcgagaagctgtccaggaagttccaggaggccttctgcgtggtgtcagacctgtgcgccacaggggaccatgactgtgagcaggtgtgcatcagctcccccggttcctacacctgcgcctgccacgagggcttcactctgaacagcgacggcaagacctgcaatgtctgcagtggtggtggtggcagctcggccactgacctggtcttcctcattgacggatccaagagtgtgaggccagagaactttgagctggtgaagaagttcatcagtcagatcgtggatacgctggacgtgtcagacaagctggcccaggtggggctggtgcagtactcaagctctgtgcgccaggagttccccctgggtcgcttccacaccaagaaggacatcaaggcggctgtgcggaatatgtcctacatggagaagggcacaatgaccggggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggtgtgggcaatgccgtggaggatgagctgagggaaatagcctcagagcctgtggcagagcactacttctacacggctgacttcaagaccatcaaccagataggcaagaagttgcagaagaagatctgtgtggaggaagacccgtgtgcctgcgagtccctggtgaaattccaagccaaagtggaggggctgctgcaggccctgaccaggaaactggaagctgtgagtaagcggctggccatcctggagaacacagttgtctaaggctgcctgtcaccactgtggcctctccaagcgtcctgcacgtgtccgccgtagctttaccattttagtgagggaagccagcccgggggtgggagggggtgtgtctgggtgtgcctattgagagcgtgtaatggcgtttgggagctcgtgtgtgtatgtgtgcgtgtgtgtatgcgtgcatgtgtgtgtgtgtgtgtgtgtgcacgtgcgcctgagggtgggcatgagtcttgccagaatgtgagtgtgagagtgataatgcaggggtgagtgtgagagggactgcgtttgcatttttataatcaaaagcttaatatattcccatctttttttagttaaccctttcttgactctgagtgctgtgaatttctttactgatttctctattctccggtgagaaacaattaaatgtgatttaacgtaagcagtgaatggggctagaggcagtgtggttatttggggaccagggaaaaggatggatgaagatgtggtgggaggggatggttggaaggatggtaacagtggtggtgacagtgatgacagtgaccacaccaaaaccagctggtgtttgtcctgccttttcagttacatattcatttagttgacctcatttcacttccagtaaccttacccagaaaagactcaaattatccccattacaaatgggaaagctgagagtctaaatgatgaaatgacttgctcagcagtgggtcgctgagagacaggacttgaatctaggactgaagaacatcaaaagaaaaaggcttcagagaaaaagggcaatgacaccagataggactcatttgttcattcattcattcgttcactcattcgttcaggtatcatgtacttacagggcaatggcggtgggggggatggtgctgtatgagacagacgtagttcctgccctaagagacatacagttgagcagggtgctcatgtcacccccaccagccagagggaccagccagaggaaaagagagtgggtttaggtcgtaccaggggtttgtgcctcctcttgatacctgggagccacggggtgagtgtgtgtgtgagatgatgggaagggctccagcctgggcctgggctgccctaggtgcctctcccctcccgcccccaacatgccctgttggagttctgtttgtttcctgtgcacaggcggcatcacccccaacccaaagtccccaacgcagatgcagcagccccacctcagagactgcacaagagaaagactcctggccccatgttcccttcctccagccctatgtggggtctgcaggtcacaccctgagatctcggtcacctcccccaggcccctattggaccagtgctgctccggaatctccatctctgtcctctcagagggggagctttggtgattttctgaacctattcttgtttaatggagcatttttagtgttactactagattcacacttgagagcatgtctaaaaggcttttacaagaagctcagaccacaccgaaagatcttcctcggaggcagttcaaagaggcagaataacaacacgaacggtacccaagagccacatcagtacaacagcacaactacacaagcgcgacttaactggggcacagccaccctcgcccccatgacctgactccacctcctacacagttcaccaagccctttctctctgtctgtccctggggcagcagtttttctgctgtccaaggaggctccttgacacagccacctgagaagttatgactctgctcattcttcctttcttctgagattatccactcccctctcctccccacacaggtggggagggggagaggcagccatgttgatatggactgagaaggctcagcagtgtgtccccaaggaggaggagagggtcattagcagacgccatggcctgggagctggtgggcagaagcaacagatgtccctgatgagtggagtcagagatggggtggaagccctgcctgggaataggacctcgttcttccctgcccggtgggtggagtagtggcaggaccttgtcaccaggctctgatgaaggcagggaccagcttcttgggatcttttaatcccaaactcttgcccttcactcatcgcagttctccccacggctactccaggtcctcttgaaatccgtcctctccatggacttcccacatccctctctgctctaggtttgattaacagaaggttgtaaatgaaaaccagcatctccctagggcagccatggtctactgacagatggcaagttactttgtaacctgtaattttgtttttttgaattttgtataaataaacaggactaaactaana

SEQ ID NO: 353947 - DNA, 934 bp, Homo sapiens
tttttaaagtaatccttatttctaagaaatacatactgatgtttttacagagaaaaattatgtaataactggaatttagtaataatacagcaggagagaaaaaagtggaaaatgatacacacaaacaagatcggccatatagttattataggtaaagtggggatggatttcattactctccctatgtttgtatatgttaggcaacacaaatgtcaaacaagacagaggaagaaaggcggcaaaatcctttgcatacctgggggttttctttctttgccttaattactaactttctgcattaggttaccttcacatgctaagaacagttgaattttcaatttcctaaggcatcagcttgcccttttctttacaagaggggctggggacataaaaaaagcaaaggtgcttcctcaaaagcttcagtgcctggcagctttattcccactgacttccccttcctcccctggactttccttctctattctgccctcacagccatcttccttcaagtcaaacccagtgctgtgtggttaggctcatttagactcagttgtattggttttctaggaagagagaagatttcactacgcagcattccccagtgccatgtcccaccggaatcggtctttctctttcaatcctcacccgggatatttgaccccttccatgaaggtaaattggttctaatggttttaatgcattatacaattccattggtttcgtttttcttaaaggtaaccacaggttatttaagggctggtgtacgctcagaaaaatattcattggaaaaaaaaaaacccacttgtttatatctatggctgggcggattatgtgtgatttttattttttatgggattttgtattttccaaattttctagaataaatgtgtgtcagtattaagaatagctctatctaggtgatgggagggagaag

SEQ ID NO: 353948 - DNA, 2129 bp, Homo sapiens
  misc_feature (1600)..(1600): n is a, c, g, or t
atccatctccagattttttgtttaagaggttgtgaacatacatatttatttataatacaaaatgaagattggagggaaaagtgctttaaaaaatagcatgtaagtgtataaatgaaattgttgcttcttctccgatacaattttgattgggtgagcattatttgcttttacaataatgctttgttttttgcattgcattgcactaacctgtccattaatacaaacagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactntgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaa

SEQ ID NO: 353949 - DNA, 6990 bp, Homo sapiens
  misc_feature (1496)..(1496): n is a, c, g, or t
  misc_feature (1954)..(1954): n is a, c, g, or t
  misc_feature (2376)..(2376): n is a, c, g, or t
  misc_feature (4288)..(4288): n is a, c, g, or t
gtctgagtgctgggcgcgttttagcgatggcttctgctctcaacagcaaaattaacccgcccggcacttgccagggctccaaagccgacggtggcgccggctggagaatggactgtgatccccagatgcacgtgaaaatgtgcaagaagatcgcccagctcaccaaggtgatttatgccctgaacacccgccaggatgaggctgaggccagcatggaggcgctgcgggaagcgcaccaggaggagctccagaatgcggtggcagagaccaaggccaggctcctgcaggaacagggctgcgcagaggaggaagcccttctacagcgcatccaggccctggagagcgccctggagctgcagaagaggctgacggaggaggcgctggctgagtcggcctcgtgcaggctggagacgaaggagagagagctgagggtggaggcagagcacgccgagcgagtcctcacgctctccagggaaatgctggagctcaaggctgactacgagaggaggctccagcacctgacgagccacgaggctaccccgcagggccggctgccccaggagagccctgaaaccaagtcggagccaggccagggcccggagatgcaggaggtcctgctagaggtgcagcggctgcgagtggagaaccagcagctgagcaaggactacgcccgcaaggccgaggagctgcaggccacctacgagagggaaaacgaggccatccggcaggccatgcagcagtcggtgagccaggccctgtggcagtggcaggagaaggagtcggacctccgcaagaacttccaggtccaggagtcagccctgcaggctcaggtccggaagctggaaggagacctggagcacagaggccgcaagataagtgacctgaagaagtacgcccagaagctgaaggagaggattcaggacctggatgtgcagcttaaggaggctcgacaggagaattcagagttgaaaggcactgcaaaaaaacttggggagaagctggctgttgccaaagacagaatgatgctgcaggagtgtcgtgggacacagcagacagatgccatgaagactgagttagtttcagagaacaaagtcctgcgggaagagaatgacttggaagccggcaatcttcatcctcagcaggatcaaagctgtctcaaggagtgcccttgcatgaaaggaggcacagatatgcagaccaagaaagaggcaagtgctgagacagaatatatgaagcaacaatatgaagaagaccttcgtaaaatcaaacatcagacagaagaggagaagaaacatctcaaagaccagctagtgaagcgactagaagacttggtaaagaagcacaccgtggaaatcaaatccgttcgctcgtccgtggaggctgaaagaaagaaactgcagagggaagtagaagcacagttggaggaagtgaggaagaaatcagaaaaggagataaagcagctggaagaagagaaagcagccctcaatgtgaagctncagaattctctgcttgaggttttaaggctggaagaatttatccaacaaaataagacacgccccacaggagctgaggaaagtccccaggaattaggccgccagcactgcagcattctggagacccaggatccatgcttgaagctggatgaaacttcgccgagaggagaggagtatcaagataagttagcagctgaagaaggaaccagcagtgatgaagaagaaaggaccaaagtgcttctcaaggagggaagtgacccacaacctccactgggctctttgttgaaggagaaaacatccaaaatccagcgtctagaggaggactggcaaagccagaaggccaaattgcaagcccaggtctcacagatgcagcaggctctggagcagtgcaccagcaactacagggaggacctgcaggcactcaagcagctctcggacctggagagggagaagctgcagcntgagctccaggagaccactcagcagaaccacgccatgaaagcccagctcgaggcttcccaccagagagccctgcgcatgctggagaaggccagacatcaggaactcaaggccacagaggaacgcttgaagaaggaatccagccacagcctccagatccaacaccagacacaccgactggagctccaggccttggaggaaaaggccaggcaagagctgcaggaggagcgtgagaggatgcaggcacagcaggccctgctgctagagtcgctcagacaggagctgtcggagcagcaagctgcctgttctgggcaccagaaggacttggaggcactgcaggccgagctgagggctctgggcagacagcaagccagcagccagtgtccaggagacagcaaggatcacataatcgccacagaggagnggggcggcccgggccaggccggctccccaccgggcgctgctgggcagggttccggcgagggatgcgggctctgggaggagaacgcgcagctccaggacgcggtgcggcggctgcgcgcggaggtggagcagcatcagcaggaggcgcagaagctccgagaccagcgcaggttcctggaggagactcagcaagcccagcgggccagggaggtggagacactgcgccaggaacaccggaaggagatgcaggccatggtggcagatttcagtagtgcccaggcccagctccaggcccggctggctgccctggaagccgaactgaaagattccggagagaagccagggaagggagcgtccaggcccgaggaccttcagctcattggccgcctgcagacccgcctgaaggagagagaggacatcatcaagcagctcacggaagagagaagatttcactacgcagcattccccagtgccatgtcccaccggaatcggtctttctctttcaatcctcacccgggatatttgaccccttccatgaagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactntgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaataaaaatggttgacttgtattgattttccacagaaaggtaaaattagatgaagacagcttagaaatagaaagttcagttcacattaacctcaatcacaccatcttaaaaaaaaaaagctgattacatataactgtcaaacttacgtattaaaggtaaatttactgcctaatcaaaacgaggctccaatgcatttttaaatgcaaacaaacacttgtcaccatacattaacacaccatactgtttttcactaccaaatattttttgtgagtttcccgcttagagtgtcttagttcgttcaggctgctctaacaaaatatcttacttatactggataatttataaacaatagaaatatgtcactcacagtcctagaggctaagtccaagatcaaggcaccagcagatatggagtctggggagggcccattcttcagaaatgggtgcctgctacgtgtccttacatggtggaagaggcaagagcgcctccctgagcctcttttgtaagggtacttatcctactcatgagggtgaagccctcatgactccattgcttcccaaaagccccacctcttaatactattacattgacattaggttccaacatatgaattttggaagggacatcaacattcaggacatagcagtgaaccctgtaggactgctctttattttgtgctttcaaaaagactacatacaggtggttctatttttgtgtgttgaaacactttcccaggctgcactttgcatttctgtccttaaactcagcatgatccctgggcaaggagaaaattttactagttgagatcgtacataggttttgactcctttcttgctgcaggtgactgaaaagatctttcagtcttaaatttctaaattctaccctgcaatgattatatctttgttaacaaaatctttgcatgcttccataattttttattgaggccatatgccttgggtattgaagtaaggcatttaaggacacaaacttaagctttttgtttgttattaccaaactgccattcagaaagtttctaacaatttacacccttaccagcagtaaatgaacctactgtgccctaacactattgacaaagaaatacaatttgatagataaaacattctattttagtttgcataatgattccatcaatctctcaacagcagagcggtctagagatgacagtgatggcgtagaggtgacagtgaagatgaagagaaattatccaattcgggattaagttaagagagagaaaaaaacagtatttgatggtaaatctcttcaggctgtattatgacaggggtggaagagttaatatgttcctgcagcaaaactgaaaggaatactatctgttccacatgaaagcaaactgttttgtaattggggtaggtaaaaatggattcacccagtcaatggctgcacaccacatacctgagcccttaactgctctaacactgatgtaatatccaacccaacatttgtgattgaggctacttggttaatttttctccaggatccatctggattctgcagatgaggctggcaaattaaatggaactatgatagggaccatcttactgtatctgtcagatttccaagggtagcactgatctctaccgtcacctcacctccacccctaggatacagtactgtgtgtttgtttttgagacggagtcttgctctgtcacccaagctggggtgcagtggcgccatctcagctcactgcaacctcggcctcccgggttcaagcgattctcctgcctcagcctcccgagtagctgggactacaggcacccgccaccatgctaattaatgtatttttagtagagacagggtttcaccatgttggccaggctggtcatgaactcctgacctcaaagtgatcctccaagataacgacagaggccccgggcactcacagtcacctcatcagttcctcactatccctctgcagggaacagacactctactgtccttgtgtgcagtactcctcttatcttccacagtttgactcctcccattcccctccacagggatattttcccagggtaccactggtggaatcctcagcaactgggccaccccctcgtgtgagtgagtgtccatacctcacacgctgctccagatgggttttgctaccagttgggcagtgagtgagccagtccccaagcctca

SEQ ID NO: 353950 - DNA, 5365 bp, Homo sapiens
  misc_feature (2663)..(2663): n is a, c, g, or t
atccatctccagattttttgtttaagaggttgtgaacatacatatttatttataatacaaaatgaagattggagggaaaagtgctttaaaaaatagcatgtaagtgtataaatgaaattgttgcttcttctccgatacaattttgattgggtgagcattatttgcttttacaataatgctttgttttttgcattgcattgcactaacctgtccattaatacaaacagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggtttgggggatgttggggacaggggcccttattctatttccctgtagataagaggggaagtaggattctttctagcacctggtaccaaattccagaaggccttttttcatggatgattagacaagggacactgaatcacttacctgaaaacttcagcatgggttatacaaaaggtggactccatctggcctggaggtctgaattcaaattacagtcttcctcattcttagctctgtggccttggacaggtcacttgacctctccaggtctccatataccttgcctttaaaattaagataatacagcacctatctcatcagactgacgtgagactaaaggaattaatccataggatgtgcttagcacaggacttggcacaaaaatcttcaatatagtttcagtattattactaacattattcctcaagatttactctatcaccttggaattctaaagtctcttaatcgggccgggcttggtggctcacgcctgtaatcccagcactttgggagatggaggtgggtggatcacctaaggtcaggagttcgagaccagcctgggcaacatggtgaaacccatctctacaaaaaatacaaaaattagccaggtgtggtggtatgcgcctgtaattccagctccccgggaggctgaggcacaatgatcgcttgaacgcaggaggctggaggttgcagtgagccgagatcatgccactgcactccagcctgggtgacagagggagactctgtcacaaaaaataaaaacaaagtctcttgatctgtaggtttggttaatcctgcattattagagctacaaccactaagtctcaaaggaacaatggagaaccaaacaatggtgaaccttctgttttcaaaatgaggattaggtactccctccccagccccatcctttacaatttgtttcccactactaatgttggccagtcccatttgggtgtttttgaagagtaaacaagcagttatctttccctgaaaagatggtgggtattaagctgcttcttgcatagttttcaaaaccatataaaaaaacctttttttgcttttaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactntgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaataaaaatggttgacttgtattgattttccacagaaaggtaaaattagatgaagacagcttagaaatagaaagttcagttcacattaacctcaatcacaccatcttaaaaaaaaaaagctgattacatataactgtcaaacttacgtattaaaggtaaatttactgcctaatcaaaacgaggctccaatgcatttttaaatgcaaacaaacacttgtcaccatacattaacacaccatactgtttttcactaccaaatattttttgtgagtttcccgcttagagtgtcttagttcgttcaggctgctctaacaaaatatcttacttatactggataatttataaacaatagaaatatgtcactcacagtcctagaggctaagtccaagatcaaggcaccagcagatatggagtctggggagggcccattcttcagaaatgggtgcctgctacgtgtccttacatggtggaagaggcaagagcgcctccctgagcctcttttgtaagggtacttatcctactcatgagggtgaagccctcatgactccattgcttcccaaaagccccacctcttaatactattacattgacattaggttccaacatatgaattttggaagggacatcaacattcaggacatagcagtgaaccctgtaggactgctctttattttgtgctttcaaaaagactacatacaggtggttctatttttgtgtgttgaaacactttcccaggctgcactttgcatttctgtccttaaactcagcatgatccctgggcaaggagaaaattttactagttgagatcgtacataggttttgactcctttcttgctgcaggtgactgaaaagatctttcagtcttaaatttctaaattctaccctgcaatgattatatctttgttaacaaaatctttgcatgcttccataattttttattgaggccatatgccttgggtattgaagtaaggcatttaaggacacaaacttaagctttttgtttgttattaccaaactgccattcagaaagtttctaacaatttacacccttaccagcagtaaatgaacctactgtgccctaacactattgacaaagaaatacaatttgatagataaaacattctattttagtttgcataatgattccatcaatctctcaacagcagagcggtctagagatgacagtgatggcgtagaggtgacagtgaagatgaagagaaattatccaattcgggattaagttaagagagagaaaaaaacagtatttgatggtaaatctcttcaggctgtattatgacaggggtggaagagttaatatgttcctgcagcaaaactgaaaggaatactatctgttccacatgaaagcaaactgttttgtaattggggtaggtaaaaatggattcacccagtcaatggctgcacaccacatacctgagcccttaactgctctaacactgatgtaatatccaacccaacatttgtgattgaggctacttggttaatttttctccaggatccatctggattctgcagatgaggctggcaaattaaatggaactatgatagggaccatcttactgtatctgtcagatttccaagggtagcactgatctctaccgtcacctcacctccacccctaggatacagtactgtgtgtttgtttttgagacggagtcttgctctgtcacccaagctggggtgcagtggcgccatctcagctcactgcaacctcggcctcccgggttcaagcgattctcctgcctcagcctcccgagtagctgggactacaggcacccgccaccatgctaattaatgtatttttagtagagacagggtttcaccatgttggccaggctggtcatgaactcctgacctcaaagtgatcctccaagataacgacagaggccccgggcactcacagtcacctcatcagttcctcactatccctctgcagggaacagacactctactgtccttgtgtgcagtactcctcttatcttccacagtttgactcctcccattcccctccacagggatattttcccagggtaccactggtggaatcctcagcaactgggccaccccctcgtgtgagtgagtgtccatacctcacacgctgctccagatgggttttgctaccagttgggcagtgagtgagccagtccccaagcctca

SEQ ID NO: 353951 - DNA, 4482 bp, Homo sapiens
atccatctccagattttttgtttaagaggttgtgaacatacatatttatttataatacaaaatgaagattggagggaaaagtgctttaaaaaatagcatgtaagtgtataaatgaaattgttgcttcttctccgatacaattttgattgggtgagcattatttgcttttacaataatgctttgttttttgcattgcattgcactaacctgtccattaatacaaacagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggtttgggggatgttggggacaggggcccttattctatttccctgtagataagaggggaagtaggattctttctagcacctggtaccaaattccagaaggccttttttcatggatgattagacaagggacactgaatcacttacctgaaaacttcagcatgggttatacaaaaggtggactccatctggcctggaggtctgaattcaaattacagtcttcctcattcttagctctgtggccttggacaggtcacttgacctctccaggtctccatataccttgcctttaaaattaagataatacagcacctatctcatcagactgacgtgagactaaaggaattaatccataggatgtgcttagcacaggacttggcacaaaaatcttcaatatagtttcagtattattactaacattattcctcaagatttactctatcaccttggaattctaaagtctcttaatcgggccgggcttggtggctcacgcctgtaatcccagcactttgggagatggaggtgggtggatcacctaaggtcaggagttcgagaccagcctgggcaacatggtgaaacccatctctacaaaaaatacaaaaattagccaggtgtggtggtatgcgcctgtaattccagctccccgggaggctgaggcacaatgatcgcttgaacgcaggaggctggaggttgcagtgagccgagatcatgccactgcactccagcctgggtgacagagggagactctgtcacaaaaaataaaaacaaagtctcttgatctgtaggtttggttaatcctgcattattagagctacaaccactaagtctcaaaggaacaatggagaaccaaacaatggtgaaccttctgttttcaaaatgaggattaggtactccctccccagccccatcctttacaatttgtttcccactactaatgttggccagtcccatttgggtgtttttgaagagtaaacaagcagttatctttccctgaaaagatggtgggtattaagctgcttcttgcatagttttcaaaaccatataaaaaaacctttttttgcttttaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaataaaaatggttgacttgtattgattttccacagaaaggtaaaattagatgaagacagcttagaaatagaaagttcagttcacattaacctcaatcacaccatcttaaaaaaaaaaagctgattacatataactgtcaaacttacgtattaaaggtaaatttactgcctaatcaaaacgaggctccaatgcatttttaaatgcaaacaaacacttgtcaccatacattaacacaccatactgtttttcactaccaaatattttttgtgagtttcccgcttagagtgtcttagttcgttcaggctgctctaacaaaatatcttacttatactggataatttataaacaatagaaatatgtcactcacagtcctagaggctaagtccaagatcaaggcaccagcagatatggagtctggggagggcccattcttcagaaatgggtgcctgctacgtgtccttacatggtggaagaggcaagagcgcctccctgagcctcttttgtaagggtacttatcctactcatgagggtgaagccctcatgactccattgcttcccaaaagccccacctcttaatactattacattgacattaggttccaacatatgaattttggaagggacatcaacattcaggacatagcagtgaaccctgtaggactgctctttattttgtgctttcaaaaagactacatacaggtggttctatttttgtgtgttgaaacactttcccaggctgcactttgcatttctgtccttaaactcagcatgatccctgggcaaggagaaaattttactagttgagatcgtacataggttttgactcctttcttgctgcaggtgactgaaaagatctttcagtcttaaatttctaaattctaccctgcaatgattatatctttgttaacaaaatctttgcatgcttccataattttttattgaggccatatgccttgggtattgaagtaaggcatttaaggacacaaacttaagctttttgtttgttattaccaaactgccattcagaaagtttctaacaatttacacccttaccagcagtaaatgaacctactgtgccctaacactattgacaaagaaatacaatttgatagataaaacattctattttagtttgcataatgattccatcaatctctcaacagcagagcggtctagagatgacagtgatggcgtagaggtgacagtgaagatgaagagaaattatccaattcgggattaagttaagagagagaaaaaaacagtatttgatggtaaatctcttcaggctgtattatgacaggggtggaagagttaatatgttcctgcagcaaaactgaaaggaatactatctgttccacatgaaagcaaactgttttgtaattggggtaggtaaaaatggattcacccagtcaatggctgcacaccacatacctgagcccttaactgctctaacactgatgtaatatccaacccaacatttgtgattgaggctacttggttaatttttctccaggatccatctggattctgcagatgaggctggcaaattaaatggaactatgatagggaccatcttactgtatctgtcagatttccaagggtagcactgatctctaccgtcacctcacctccacccctaggatacagtactgtgtgtttgtttttgagacggagtcttgctctgtcacccaagctggggtgcagtggcgccatctcagctcactgcaacctcggcctcccgggttcaagcgattctcctgcctcagcctcccgagtagctgggactacaggcacccgccaccatgctaattaatgtatttttagtagagacagggtttcaccatgttggccaggctggtcatgaactcctgacctcaaagtgatcctccaagataacgacagaggccccgggcactcacagtcacctcatcagttcctcactatccctctgcagggaacagacactctactgtccttgtgtgcagtactcctcttatcttccacagtttgactcctcccattcccctccacagggatattttcccagggtaccactggtggaatcctcagcaactgggccaccccctcgtgtgagtgagtgtccatacctcacacgctgctccagatgggttttgctaccagttgggcagtgagtgagccagtccccaagcctca

SEQ ID NO: 353952 - DNA, 4817 bp, Homo sapiens
  misc_feature (1496)..(1496): n is a, c, g, or t
  misc_feature (1954)..(1954): n is a, c, g, or t
  misc_feature (2376)..(2376): n is a, c, g, or t
  misc_feature (4288)..(4288): n is a, c, g, or t
gtctgagtgctgggcgcgttttagcgatggcttctgctctcaacagcaaaattaacccgcccggcacttgccagggctccaaagccgacggtggcgccggctggagaatggactgtgatccccagatgcacgtgaaaatgtgcaagaagatcgcccagctcaccaaggtgatttatgccctgaacacccgccaggatgaggctgaggccagcatggaggcgctgcgggaagcgcaccaggaggagctccagaatgcggtggcagagaccaaggccaggctcctgcaggaacagggctgcgcagaggaggaagcccttctacagcgcatccaggccctggagagcgccctggagctgcagaagaggctgacggaggaggcgctggctgagtcggcctcgtgcaggctggagacgaaggagagagagctgagggtggaggcagagcacgccgagcgagtcctcacgctctccagggaaatgctggagctcaaggctgactacgagaggaggctccagcacctgacgagccacgaggctaccccgcagggccggctgccccaggagagccctgaaaccaagtcggagccaggccagggcccggagatgcaggaggtcctgctagaggtgcagcggctgcgagtggagaaccagcagctgagcaaggactacgcccgcaaggccgaggagctgcaggccacctacgagagggaaaacgaggccatccggcaggccatgcagcagtcggtgagccaggccctgtggcagtggcaggagaaggagtcggacctccgcaagaacttccaggtccaggagtcagccctgcaggctcaggtccggaagctggaaggagacctggagcacagaggccgcaagataagtgacctgaagaagtacgcccagaagctgaaggagaggattcaggacctggatgtgcagcttaaggaggctcgacaggagaattcagagttgaaaggcactgcaaaaaaacttggggagaagctggctgttgccaaagacagaatgatgctgcaggagtgtcgtgggacacagcagacagatgccatgaagactgagttagtttcagagaacaaagtcctgcgggaagagaatgacttggaagccggcaatcttcatcctcagcaggatcaaagctgtctcaaggagtgcccttgcatgaaaggaggcacagatatgcagaccaagaaagaggcaagtgctgagacagaatatatgaagcaacaatatgaagaagaccttcgtaaaatcaaacatcagacagaagaggagaagaaacatctcaaagaccagctagtgaagcgactagaagacttggtaaagaagcacaccgtggaaatcaaatccgttcgctcgtccgtggaggctgaaagaaagaaactgcagagggaagtagaagcacagttggaggaagtgaggaagaaatcagaaaaggagataaagcagctggaagaagagaaagcagccctcaatgtgaagctncagaattctctgcttgaggttttaaggctggaagaatttatccaacaaaataagacacgccccacaggagctgaggaaagtccccaggaattaggccgccagcactgcagcattctggagacccaggatccatgcttgaagctggatgaaacttcgccgagaggagaggagtatcaagataagttagcagctgaagaaggaaccagcagtgatgaagaagaaaggaccaaagtgcttctcaaggagggaagtgacccacaacctccactgggctctttgttgaaggagaaaacatccaaaatccagcgtctagaggaggactggcaaagccagaaggccaaattgcaagcccaggtctcacagatgcagcaggctctggagcagtgcaccagcaactacagggaggacctgcaggcactcaagcagctctcggacctggagagggagaagctgcagcntgagctccaggagaccactcagcagaaccacgccatgaaagcccagctcgaggcttcccaccagagagccctgcgcatgctggagaaggccagacatcaggaactcaaggccacagaggaacgcttgaagaaggaatccagccacagcctccagatccaacaccagacacaccgactggagctccaggccttggaggaaaaggccaggcaagagctgcaggaggagcgtgagaggatgcaggcacagcaggccctgctgctagagtcgctcagacaggagctgtcggagcagcaagctgcctgttctgggcaccagaaggacttggaggcactgcaggccgagctgagggctctgggcagacagcaagccagcagccagtgtccaggagacagcaaggatcacataatcgccacagaggagnggggcggcccgggccaggccggctccccaccgggcgctgctgggcagggttccggcgagggatgcgggctctgggaggagaacgcgcagctccaggacgcggtgcggcggctgcgcgcggaggtggagcagcatcagcaggaggcgcagaagctccgagaccagcgcaggttcctggaggagactcagcaagcccagcgggccagggaggtggagacactgcgccaggaacaccggaaggagatgcaggccatggtggcagatttcagtagtgcccaggcccagctccaggcccggctggctgccctggaagccgaactgaaagattccggagagaagccagggaagggagcgtccaggcccgaggaccttcagctcattggccgcctgcagacccgcctgaaggagagagaggacatcatcaagcagctcacggaagagagaagatttcactacgcagcattccccagtgccatgtcccaccggaatcggtctttctctttcaatcctcacccgggatatttgaccccttccatgaagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactntgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaa

SEQ ID NO: 353953 - DNA, 4302 bp, Homo sapiens
  misc_feature (1600)..(1600): n is a, c, g, or t
atccatctccagattttttgtttaagaggttgtgaacatacatatttatttataatacaaaatgaagattggagggaaaagtgctttaaaaaatagcatgtaagtgtataaatgaaattgttgcttcttctccgatacaattttgattgggtgagcattatttgcttttacaataatgctttgttttttgcattgcattgcactaacctgtccattaatacaaacagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactntgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaataaaaatggttgacttgtattgattttccacagaaaggtaaaattagatgaagacagcttagaaatagaaagttcagttcacattaacctcaatcacaccatcttaaaaaaaaaaagctgattacatataactgtcaaacttacgtattaaaggtaaatttactgcctaatcaaaacgaggctccaatgcatttttaaatgcaaacaaacacttgtcaccatacattaacacaccatactgtttttcactaccaaatattttttgtgagtttcccgcttagagtgtcttagttcgttcaggctgctctaacaaaatatcttacttatactggataatttataaacaatagaaatatgtcactcacagtcctagaggctaagtccaagatcaaggcaccagcagatatggagtctggggagggcccattcttcagaaatgggtgcctgctacgtgtccttacatggtggaagaggcaagagcgcctccctgagcctcttttgtaagggtacttatcctactcatgagggtgaagccctcatgactccattgcttcccaaaagccccacctcttaatactattacattgacattaggttccaacatatgaattttggaagggacatcaacattcaggacatagcagtgaaccctgtaggactgctctttattttgtgctttcaaaaagactacatacaggtggttctatttttgtgtgttgaaacactttcccaggctgcactttgcatttctgtccttaaactcagcatgatccctgggcaaggagaaaattttactagttgagatcgtacataggttttgactcctttcttgctgcaggtgactgaaaagatctttcagtcttaaatttctaaattctaccctgcaatgattatatctttgttaacaaaatctttgcatgcttccataattttttattgaggccatatgccttgggtattgaagtaaggcatttaaggacacaaacttaagctttttgtttgttattaccaaactgccattcagaaagtttctaacaatttacacccttaccagcagtaaatgaacctactgtgccctaacactattgacaaagaaatacaatttgatagataaaacattctattttagtttgcataatgattccatcaatctctcaacagcagagcggtctagagatgacagtgatggcgtagaggtgacagtgaagatgaagagaaattatccaattcgggattaagttaagagagagaaaaaaacagtatttgatggtaaatctcttcaggctgtattatgacaggggtggaagagttaatatgttcctgcagcaaaactgaaaggaatactatctgttccacatgaaagcaaactgttttgtaattggggtaggtaaaaatggattcacccagtcaatggctgcacaccacatacctgagcccttaactgctctaacactgatgtaatatccaacccaacatttgtgattgaggctacttggttaatttttctccaggatccatctggattctgcagatgaggctggcaaattaaatggaactatgatagggaccatcttactgtatctgtcagatttccaagggtagcactgatctctaccgtcacctcacctccacccctaggatacagtactgtgtgtttgtttttgagacggagtcttgctctgtcacccaagctggggtgcagtggcgccatctcagctcactgcaacctcggcctcccgggttcaagcgattctcctgcctcagcctcccgagtagctgggactacaggcacccgccaccatgctaattaatgtatttttagtagagacagggtttcaccatgttggccaggctggtcatgaactcctgacctcaaagtgatcctccaagataacgacagaggccccgggcactcacagtcacctcatcagttcctcactatccctctgcagggaacagacactctactgtccttgtgtgcagtactcctcttatcttccacagtttgactcctcccattcccctccacagggatattttcccagggtaccactggtggaatcctcagcaactgggccaccccctcgtgtgagtgagtgtccatacctcacacgctgctccagatgggttttgctaccagttgggcagtgagtgagccagtccccaagcctca

SEQ ID NO: 353954 - DNA, 2553 bp, Homo sapiens
atccatctccagattttttgtttaagaggttgtgaacatacatatttatttataatacaaaatgaagattggagggaaaagtgctttaaaaaatagcatgtaagtgtataaatgaaattgttgcttcttctccgatacaattttgattgggtgagcattatttgcttttacaataatgctttgttttttgcattgcattgcactaacctgtccattaatacaaacagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggtttgggggatgttggggacaggggcccttattctatttccctgtagataagaggggaagtaggattctttctagcacctggtaccaaattccagaaggccttttttcatggatgattagacaagggacactgaatcacttacctgaaaacttcagcatgggttatacaaaaggtggactccatctggcctggaggtctgaattcaaattacagtcttcctcattcttagctctgtggccttggacaggtcacttgacctctccaggtctccatataccttgcctttaaaattaagataatacagcacctatctcatcagactgacgtgagactaaaggaattaatccataggatgtgcttagcacaggacttggcacaaaaatcttcaatatagtttcagtattattactaacattattcctcaagatttactctatcaccttggaattctaaagtctcttaatcgggccgggcttggtggctcacgcctgtaatcccagcactttgggagatggaggtgggtggatcacctaaggtcaggagttcgagaccagcctgggcaacatggtgaaacccatctctacaaaaaatacaaaaattagccaggtgtggtggtatgcgcctgtaattccagctccccgggaggctgaggcacaatgatcgcttgaacgcaggaggctggaggttgcagtgagccgagatcatgccactgcactccagcctgggtgacagagggagactctgtcacaaaaaataaaaacaaagtctcttgatctgtaggtttggttaatcctgcattattagagctacaaccactaagtctcaaaggaacaatggagaaccaaacaatggtgaaccttctgttttcaaaatgaggattaggtactccctccccagccccatcctttacaatttgtttcccactactaatgttggccagtcccatttgggtgtttttgaagagtaaacaagcagttatctttccctgaaaagatggtgggtattaagctgcttcttgcatagttttcaaaaccatataaaaaaacctttttttgcttttaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatatttgtgattgaggctacttggttaatttttctccaggatccatctggattctgcagatgaggctggcaaattaaatggaactatgatagggaccatcttactgtatctgtcagatttccaagggtagcactgatctctaccgtcacctcacctccacccctaggatacagtactgtgtgtttgtttttgagacggagtcttgctctgtcacccaagctggggtgcagtggcgccatctcagctcactgcaacctcggcctcccgggttcaagcgattctcctgcctcagcctcccgagtagctgggactacaggcacccgccaccatgctaattaatgtatttttagtagagacagggtttcaccatgttggccaggctggtcatgaactcctgacctcaaagtgatcctccaagataacgacagaggccccgggcactcacagtcacctcatcagttcctcactatccctctgcagggaacagacactctactgtccttgtgtgcagtactcctcttatcttccacagtttgactcctcccattcccctccacagggatattttcccagggtaccactggtggaatcctcagcaactgggccaccccctcgtgtgagtgagtgtccatacctcacacgctgctccagatgggttttgctaccagttgggcagtgagtgagccagtccccaagcctca

SEQ ID NO: 353955 - DNA, 317 bp, Homo sapiens
gatccatgcttgaagctggatgaaacttcgccgagaggagaggagtatcaagataagttagcagctgaagaaggaaccagcagtgatgaagaagaaaggtacaggaggacatgcagacttctgagtgctccattgaatgaggactcagatgtggaaggattcatccattcattcattctatcctcaagtatttatcactgctccttgcagcatgcttggggaggcaacaagcatatcttgtatgtcttcagcacagctatgggcttcacataaactgtgttacttaattgttacaacaacccagagaagccattttt

SEQ ID NO: 353956 - DNA, 5810 bp, Homo sapiens
  misc_feature (3108)..(3108): n is a, c, g, or t
tttttaaagtaatccttatttctaagaaatacatactgatgtttttacagagaaaaattatgtaataactggaatttagtaataatacagcaggagagaaaaaagtggaaaatgatacacacaaacaagatcggccatatagttattataggtaaagtggggatggatttcattactctccctatgtttgtatatgttaggcaacacaaatgtcaaacaagacagaggaagaaaggcggcaaaatcctttgcatacctgggggttttctttctttgccttaattactaactttctgcattaggttaccttcacatgctaagaacagttgaattttcaatttcctaaggcatcagcttgcccttttctttacaagaggggctggggacataaaaaaagcaaaggtgcttcctcaaaagcttcagtgcctggcagctttattcccactgacttccccttcctcccctggactttccttctctattctgccctcacagccatcttccttcaagtcaaacccagtgctgtgtggttaggctcatttagactcagttgtattggttttctaggaagagagaagatttcactacgcagcattccccagtgccatgtcccaccggaatcggtctttctctttcaatcctcacccgggatatttgaccccttccatgaagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggtttgggggatgttggggacaggggcccttattctatttccctgtagataagaggggaagtaggattctttctagcacctggtaccaaattccagaaggccttttttcatggatgattagacaagggacactgaatcacttacctgaaaacttcagcatgggttatacaaaaggtggactccatctggcctggaggtctgaattcaaattacagtcttcctcattcttagctctgtggccttggacaggtcacttgacctctccaggtctccatataccttgcctttaaaattaagataatacagcacctatctcatcagactgacgtgagactaaaggaattaatccataggatgtgcttagcacaggacttggcacaaaaatcttcaatatagtttcagtattattactaacattattcctcaagatttactctatcaccttggaattctaaagtctcttaatcgggccgggcttggtggctcacgcctgtaatcccagcactttgggagatggaggtgggtggatcacctaaggtcaggagttcgagaccagcctgggcaacatggtgaaacccatctctacaaaaaatacaaaaattagccaggtgtggtggtatgcgcctgtaattccagctccccgggaggctgaggcacaatgatcgcttgaacgcaggaggctggaggttgcagtgagccgagatcatgccactgcactccagcctgggtgacagagggagactctgtcacaaaaaataaaaacaaagtctcttgatctgtaggtttggttaatcctgcattattagagctacaaccactaagtctcaaaggaacaatggagaaccaaacaatggtgaaccttctgttttcaaaatgaggattaggtactccctccccagccccatcctttacaatttgtttcccactactaatgttggccagtcccatttgggtgtttttgaagagtaaacaagcagttatctttccctgaaaagatggtgggtattaagctgcttcttgcatagttttcaaaaccatataaaaaaacctttttttgcttttaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactntgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaataaaaatggttgacttgtattgattttccacagaaaggtaaaattagatgaagacagcttagaaatagaaagttcagttcacattaacctcaatcacaccatcttaaaaaaaaaaagctgattacatataactgtcaaacttacgtattaaaggtaaatttactgcctaatcaaaacgaggctccaatgcatttttaaatgcaaacaaacacttgtcaccatacattaacacaccatactgtttttcactaccaaatattttttgtgagtttcccgcttagagtgtcttagttcgttcaggctgctctaacaaaatatcttacttatactggataatttataaacaatagaaatatgtcactcacagtcctagaggctaagtccaagatcaaggcaccagcagatatggagtctggggagggcccattcttcagaaatgggtgcctgctacgtgtccttacatggtggaagaggcaagagcgcctccctgagcctcttttgtaagggtacttatcctactcatgagggtgaagccctcatgactccattgcttcccaaaagccccacctcttaatactattacattgacattaggttccaacatatgaattttggaagggacatcaacattcaggacatagcagtgaaccctgtaggactgctctttattttgtgctttcaaaaagactacatacaggtggttctatttttgtgtgttgaaacactttcccaggctgcactttgcatttctgtccttaaactcagcatgatccctgggcaaggagaaaattttactagttgagatcgtacataggttttgactcctttcttgctgcaggtgactgaaaagatctttcagtcttaaatttctaaattctaccctgcaatgattatatctttgttaacaaaatctttgcatgcttccataattttttattgaggccatatgccttgggtattgaagtaaggcatttaaggacacaaacttaagctttttgtttgttattaccaaactgccattcagaaagtttctaacaatttacacccttaccagcagtaaatgaacctactgtgccctaacactattgacaaagaaatacaatttgatagataaaacattctattttagtttgcataatgattccatcaatctctcaacagcagagcggtctagagatgacagtgatggcgtagaggtgacagtgaagatgaagagaaattatccaattcgggattaagttaagagagagaaaaaaacagtatttgatggtaaatctcttcaggctgtattatgacaggggtggaagagttaatatgttcctgcagcaaaactgaaaggaatactatctgttccacatgaaagcaaactgttttgtaattggggtaggtaaaaatggattcacccagtcaatggctgcacaccacatacctgagcccttaactgctctaacactgatgtaatatccaacccaacatttgtgattgaggctacttggttaatttttctccaggatccatctggattctgcagatgaggctggcaaattaaatggaactatgatagggaccatcttactgtatctgtcagatttccaagggtagcactgatctctaccgtcacctcacctccacccctaggatacagtactgtgtgtttgtttttgagacggagtcttgctctgtcacccaagctggggtgcagtggcgccatctcagctcactgcaacctcggcctcccgggttcaagcgattctcctgcctcagcctcccgagtagctgggactacaggcacccgccaccatgctaattaatgtatttttagtagagacagggtttcaccatgttggccaggctggtcatgaactcctgacctcaaagtgatcctccaagataacgacagaggccccgggcactcacagtcacctcatcagttcctcactatccctctgcagggaacagacactctactgtccttgtgtgcagtactcctcttatcttccacagtttgactcctcccattcccctccacagggatattttcccagggtaccactggtggaatcctcagcaactgggccaccccctcgtgtgagtgagtgtccatacctcacacgctgctccagatgggttttgctaccagttgggcagtgagtgagccagtccccaagcctca

SEQ ID NO: 353957 - DNA, 7273 bp, Homo sapiens
  misc_feature (716)..(716): n is a, c, g, or t
  misc_feature (1174)..(1174): n is a, c, g, or t
  misc_feature (1596)..(1596): n is a, c, g, or t
  misc_feature (4571)..(4571): n is a, c, g, or t
ttgttggcggcctgctgaggttgaagcacaagcggctggaagcagaactggctgcgcatgagccggctattcagggtgtcctggacactggcaagaagctgtccgatgacaacaccatcgggaaagaggagaggattcaggacctggatgtgcagcttaaggaggctcgacaggagaattcagagttgaaaggcactgcaaaaaaacttggggagaagctggctgttgccaaagacagaatgatgctgcaggagtgtcgtgggacacagcagacagatgccatgaagactgagttagtttcagagaacaaagtcctgcgggaagagaatgacttggaagccggcaatcttcatcctcagcaggatcaaagctgtctcaaggagtgcccttgcatgaaaggaggcacagatatgcagaccaagaaagaggcaagtgctgagacagaatatatgaagcaacaatatgaagaagaccttcgtaaaatcaaacatcagacagaagaggagaagaaacatctcaaagaccagctagtgaagcgactagaagacttggtaaagaagcacaccgtggaaatcaaatccgttcgctcgtccgtggaggctgaaagaaagaaactgcagagggaagtagaagcacagttggaggaagtgaggaagaaatcagaaaaggagataaagcagctggaagaagagaaagcagccctcaatgtgaagctncagaattctctgcttgaggttttaaggctggaagaatttatccaacaaaataagacacgccccacaggagctgaggaaagtccccaggaattaggccgccagcactgcagcattctggagacccaggatccatgcttgaagctggatgaaacttcgccgagaggagaggagtatcaagataagttagcagctgaagaaggaaccagcagtgatgaagaagaaaggaccaaagtgcttctcaaggagggaagtgacccacaacctccactgggctctttgttgaaggagaaaacatccaaaatccagcgtctagaggaggactggcaaagccagaaggccaaattgcaagcccaggtctcacagatgcagcaggctctggagcagtgcaccagcaactacagggaggacctgcaggcactcaagcagctctcggacctggagagggagaagctgcagcntgagctccaggagaccactcagcagaaccacgccatgaaagcccagctcgaggcttcccaccagagagccctgcgcatgctggagaaggccagacatcaggaactcaaggccacagaggaacgcttgaagaaggaatccagccacagcctccagatccaacaccagacacaccgactggagctccaggccttggaggaaaaggccaggcaagagctgcaggaggagcgtgagaggatgcaggcacagcaggccctgctgctagagtcgctcagacaggagctgtcggagcagcaagctgcctgttctgggcaccagaaggacttggaggcactgcaggccgagctgagggctctgggcagacagcaagccagcagccagtgtccaggagacagcaaggatcacataatcgccacagaggagnggggcggcccgggccaggccggctccccaccgggcgctgctgggcagggttccggcgagggatgcgggctctgggaggagaacgcgcagctccaggacgcggtgcggcggctgcgcgcggaggtggagcagcatcagcaggaggcgcagaagctccgagaccagcgcaggttcctggaggagactcagcaagcccagcgggccagggaggtggagacactgcgccaggaacaccggaaggagatgcaggccatggtggcagatttcagtagtgcccaggcccagctccaggcccggctggctgccctggaagccgaactgaaagattccggagagaagccagggaagggagcgtccaggcccgaggaccttcagctcattggccgcctgcagacccgcctgaaggagagagaggacatcatcaagcagctcacggaagagagaagatttcactacgcagcattccccagtgccatgtcccaccggaatcggtctttctctttcaatcctcacccgggatatttgaccccttccatgaagaaaaagaaggtggaggacgtgcccagccgcgtggtcagcgtgccgaacctcgcctcctatgcaaagaactttctgagtggcgatctgagttccaggattaatgcccctccaataactacatcacccagcttggacccaagccccagctgtggccggacctacaaacccaaccagtctacagatgcaaaaactgccacaaggtttgggggatgttggggacaggggcccttattctatttccctgtagataagaggggaagtaggattctttctagcacctggtaccaaattccagaaggccttttttcatggatgattagacaagggacactgaatcacttacctgaaaacttcagcatgggttatacaaaaggtggactccatctggcctggaggtctgaattcaaattacagtcttcctcattcttagctctgtggccttggacaggtcacttgacctctccaggtctccatataccttgcctttaaaattaagataatacagcacctatctcatcagactgacgtgagactaaaggaattaatccataggatgtgcttagcacaggacttggcacaaaaatcttcaatatagtttcagtattattactaacattattcctcaagatttactctatcaccttggaattctaaagtctcttaatcgggccgggcttggtggctcacgcctgtaatcccagcactttgggagatggaggtgggtggatcacctaaggtcaggagttcgagaccagcctgggcaacatggtgaaacccatctctacaaaaaatacaaaaattagccaggtgtggtggtatgcgcctgtaattccagctccccgggaggctgaggcacaatgatcgcttgaacgcaggaggctggaggttgcagtgagccgagatcatgccactgcactccagcctgggtgacagagggagactctgtcacaaaaaataaaaacaaagtctcttgatctgtaggtttggttaatcctgcattattagagctacaaccactaagtctcaaaggaacaatggagaaccaaacaatggtgaaccttctgttttcaaaatgaggattaggtactccctccccagccccatcctttacaatttgtttcccactactaatgttggccagtcccatttgggtgtttttgaagagtaaacaagcagttatctttccctgaaaagatggtgggtattaagctgcttcttgcatagttttcaaaaccatataaaaaaacctttttttgcttttaggaccccagatggtgaaacggcccaagccaaagaagcccagcagaaacagggctctccgcaccaggaatggttcaccaagtacttttctttctaagctaacctttgggatacatcacagaggatacttgaaaaacatttattttaaatcatccgattgaaggaatgaactaacaccaaccaaccaaataatatgcttatgatttatatatgatagctaaaacaaattttggcgttaacacttcatactgttctgccaggcacagcagctcacgcctgtaatcccatcactttgggaggctgaggcagatggactgcttgagtccaggaatttgagaccagcctggccaatatggtgaaaccccatctctacaaaatatacaaaaattagccaggcatggtggcgtgtgcctgtggtcccaggtacttgggggactgaggcgggaggatcacttgaacctaggaggcagaggttgcagtgagccaagttcgaactcctgcattccaaccagcctgggtgacagagggagaccctgtctccaaaaaaaaaaaaaaaaattgacattaaaccagtgttattaaaagtcatctataggaaaatgttattagcgttactaatgacccataccttgtatttctagtgtccataacatcatactccattttgtggaacatcagactttgtgatttccatgatctatttcaaaagtggttgtacttgtccttaggatgctagtcaactccactggaaagctgtttctatgtaaaatgatgcaattccaaaatgcacatctaacctcaataggaagacaaataacagttaaacaggaaagccaactaaaaacaaaccaaacctaccagaaatggatggtagcatgcttggactgaatactttcacttccttggtctaagacaagcagcagattatagatgggataacacccacctctaaaagggctttgcaaggattaagcaagataacataaattaacatgaattggaattaagtaccacaaggtttttctgtaaataaccaatcctagcccagttataggtctcagtgtaatgaccatagtgccaacatgatcacttgtgaaggtctctagattatctgttctttgaagtcaaagatcttctagactgggcacatggctcatgcctgtaatcccaacactntgggaggctgagatgggaggagagcttgaggccaggaatttgagaccagcctgggcaacacagcgagacctccatctctacaaaaaaataattagcccaaagaaaacccagctacttggaagtctgaggtaggacagcatgagcccaagagttcgagaccagcctgggcaagatagtgagatcccatctctacagattaaaaaaatatatatatatatcccctgaacctctggtctttgggtttgagccatttgcctcatggtgtgttgcttcttcactgcatgaattcccagtgggttaaaggaaccgcaatggctgttcacggtgctgaccttgctctcagtccacactgatttgtcttaccttctgacagagcaatgtgatttgacaagactcaataacaacttttagggggcaaaatattttttcagtctttggtgctggcccagaaggtggcccacaaaccaatgttaattctatgcattgtcaaatctttgctctttgaataaaactttgaataactgggcaataaaaatggttgacttgtattgattttccacagaaaggtaaaattagatgaagacagcttagaaatagaaagttcagttcacattaacctcaatcacaccatcttaaaaaaaaaaagctgattacatataactgtcaaacttacgtattaaaggtaaatttactgcctaatcaaaacgaggctccaatgcatttttaaatgcaaacaaacacttgtcaccatacattaacacaccatactgtttttcactaccaaatattttttgtgagtttcccgcttagagtgtcttagttcgttcaggctgctctaacaaaatatcttacttatactggataatttataaacaatagaaatatgtcactcacagtcctagaggctaagtccaagatcaaggcaccagcagatatggagtctggggagggcccattcttcagaaatgggtgcctgctacgtgtccttacatggtggaagaggcaagagcgcctccctgagcctcttttgtaagggtacttatcctactcatgagggtgaagccctcatgactccattgcttcccaaaagccccacctcttaatactattacattgacattaggttccaacatatgaattttggaagggacatcaacattcaggacatagcagtgaaccctgtaggactgctctttattttgtgctttcaaaaagactacatacaggtggttctatttttgtgtgttgaaacactttcccaggctgcactttgcatttctgtccttaaactcagcatgatccctgggcaaggagaaaattttactagttgagatcgtacataggttttgactcctttcttgctgcaggtgactgaaaagatctttcagtcttaaatttctaaattctaccctgcaatgattatatctttgttaacaaaatctttgcatgcttccataattttttattgaggccatatgccttgggtattgaagtaaggcatttaaggacacaaacttaagctttttgtttgttattaccaaactgccattcagaaagtttctaacaatttacacccttaccagcagtaaatgaacctactgtgccctaacactattgacaaagaaatacaatttgatagataaaacattctattttagtttgcataatgattccatcaatctctcaacagcagagcggtctagagatgacagtgatggcgtagaggtgacagtgaagatgaagagaaattatccaattcgggattaagttaagagagagaaaaaaacagtatttgatggtaaatctcttcaggctgtattatgacaggggtggaagagttaatatgttcctgcagcaaaactgaaaggaatactatctgttccacatgaaagcaaactgttttgtaattggggtaggtaaaaatggattcacccagtcaatggctgcacaccacatacctgagcccttaactgctctaacactgatgtaatatccaacccaacatttgtgattgaggctacttggttaatttttctccaggatccatctggattctgcagatgaggctggcaaattaaatggaactatgatagggaccatcttactgtatctgtcagatttccaagggtagcactgatctctaccgtcacctcacctccacccctaggatacagtactgtgtgtttgtttttgagacggagtcttgctctgtcacccaagctggggtgcagtggcgccatctcagctcactgcaacctcggcctcccgggttcaagcgattctcctgcctcagcctcccgagtagctgggactacaggcacccgccaccatgctaattaatgtatttttagtagagacagggtttcaccatgttggccaggctggtcatgaactcctgacctcaaagtgatcctccaagataacgacagaggccccgggcactcacagtcacctcatcagttcctcactatccctctgcagggaacagacactctactgtccttgtgtgcagtactcctcttatcttccacagtttgactcctcccattcccctccacagggatattttcccagggtaccactggtggaatcctcagcaactgggccaccccctcgtgtgagtgagtgtccatacctcacacgctgctccagatgggttttgctaccagttgggcagtgagtgagccagtccccaagcctca

SEQ ID NO: 353958 - DNA, 629 bp, Homo sapiens
agtcaggtctcccaccctcatgcccactttcatgccttcttgttcccactttttcccacaggccacagaggaacgcttgaagaaggaatccagccacagcctccagatccaacaccagacacaccgactggagctccaggccttggaggaaaaggccaggcaagagctgcaggaggagcgtgagaggatgcaggcacagcaggccctgctgctaggtatacacccaatagtgtactgaggagggcctggccaactgcagggtctgcatgtagaaaccagagacaagctgagggccagggctccagggttctcgggctcacaggccacggctccgggaatctcaggctcacaggccagggctccagggctctcagattcacaggccagggctccaggctctcaggcacacaggccagggctccaggggtctcgggctcacaggccagggctccaggaatctcaggcacacatgtcagggacaatcctggctctgccaccaactagctgtgaaacctgggatggcttactgtgagtctcattttccttttgtataaaattgaattacagttgtccctacctcataggctcactgtgtggattaaatgagatattaaacataaaggccgggt

SEQ ID NO: 353959 - DNA, 1221 bp, Homo sapiens
gtttcccgctctgcgaggtggggtcaggccaagacgaggaggagcccgcgcaagcgcactcaccaccacggcggtgaccggctggcccgggatgtaggacatctcgaccctgctctggtcgcccagcgccgctccgagaagccggcagcagagtacccgcggtcgcccctcgctgcttaacaaaggccgccccgctcggcccgccccctcatgaatagttaacaaacctccagccaatcactggccggagcgccactccgctttcggaagtccctgcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacacaaaaaacaccaccccacacacccccccgcggcgccatttccgggcgcggaacaaacgggttctcgacaacgggcccctggccacagccggctcctgaccccgcttctctcgcccaccgggaactccccggtccccacaacggccccaaaatcccaaaacccggaccgtcccccccccg

SEQ ID NO: 353960 - DNA, 1420 bp, Homo sapiens
gtttcccgctctgcgaggtggggtcaggccaagacgaggaggagcccgcgcaagcgcactcaccaccacggcggtgaccggctggcccgggatgtaggacatctcgaccctgctctggtcgcccagcgccgctccgagaagccggcagcagagtacccgcggtcgcccctcgctgcttaacaaaggccgccccgctcggcccgccccctcatgaatagttaacaaacctccagccaatcactggccggagcgccactccgctttcggaagtccctgcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccaggtctcggaagctccagggggagggggcggcgtgaacccaactcaccgagctccgggcgccacttgtaacttggttttctccgcagcctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacacaaaaaacaccaccccacacacccccccgcggcgccatttccgggcgcggaacaaacgggttctcgacaacgggcccctggccacagccggctcctgaccccgcttctctcgcccaccgggaactccccggtccccacaacggccccaaaatcccaaaacccggaccgtcccccccccg

SEQ ID NO: 353961 - DNA, 1350 bp, Homo sapiens
gtttcccgctctgcgaggtggggtcaggccaagacgaggaggagcccgcgcaagcgcactcaccaccacggcggtgaccggctggcccgggatgtaggacatctcgaccctgctctggtcgcccagcgccgctccgagaagccggcagcagagtacccgcggtcgcccctcgctgcttaacaaaggccgccccgctcggcccgccccctcatgaatagttaacaaacctccagccaatcactggccggagcgccactccgctttcggaagtccctgcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagataatgagggggagaaaaaaaacaaaggggggggcaaatatccgagggcaaggtaggtcccgcttttggccagggctaaggggggttaagacaggcgggcgggttaaagggaggggaagggatggttgggggccatcgggggatggaaccacagaacccgatctaagttggactctgaagtgaaaaaacaaaaacaagaagttgacgccgaaatt

SEQ ID NO: 353962 - DNA, 1108 bp, Homo sapiens
gtttcccgctctgcgaggtggggtcaggccaagacgaggaggagcccgcgcaagcgcactcaccaccacggcggtgaccggctggcccgggatgtaggacatctcgaccctgctctggtcgcccagcgccgctccgagaagccggcagcagagtacccgcggtcgcccctcgctgcttaacaaaggccgccccgctcggcccgccccctcatgaatagttaacaaacctccagccaatcactggccggagcgccactccgctttcggaagtccctgcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctga

SEQ ID NO: 353963 - DNA, 825 bp, Homo sapiens
gtttcccgctctgcgaggtggggtcaggccaagacgaggaggagcccgcgcaagcgcactcaccaccacggcggtgaccggctggcccgggatgtaggacatctcgaccctgctctggtcgcccagcgccgctccgagaagccggcagcagagtacccgcggtcgcccctcgctgcttaacaaaggccgccccgctcggcccgccccctcatgaatagttaacaaacctccagccaatcactggccggagcgccactccgctttcggaagtccctgcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagagcctgtaatatttgttccaccccctgctcctcattctcaaggcgggaaggaggtgg

SEQ ID NO: 353964 - DNA, 1334 bp, Homo sapiens
gtttcccgctctgcgaggtggggtcaggccaagacgaggaggagcccgcgcaagcgcactcaccaccacggcggtgaccggctggcccgggatgtaggacatctcgaccctgctctggtcgcccagcgccgctccgagaagccggcagcagagtacccgcggtcgcccctcgctgcttaacaaaggccgccccgctcggcccgccccctcatgaatagttaacaaacctccagccaatcactggccggagcgccactccgctttcggaagtccctgcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacacaaaaaacaccaccccacacacccccccgcggcgccatttccgggcgcggaacaaacgggttctcgacaacgggcccctggccacagccggctcctgaccccgcttctctcgcccaccgggaactccccggtccccacaacggccccaaaatcccaaaacccggaccgtcccccccccg

SEQ ID NO: 353965 - DNA, 995 bp, Homo sapiens
gtttcccgctctgcgaggtggggtcaggccaagacgaggaggagcccgcgcaagcgcactcaccaccacggcggtgaccggctggcccgggatgtaggacatctcgaccctgctctggtcgcccagcgccgctccgagaagccggcagcagagtacccgcggtcgcccctcgctgcttaacaaaggccgccccgctcggcccgccccctcatgaatagttaacaaacctccagccaatcactggccggagcgccactccgctttcggaagtccctgcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctga

SEQ ID NO: 353966 - DNA, 932 bp, Homo sapiens
gtttcccgctctgcgaggtggggtcaggccaagacgaggaggagcccgcgcaagcgcactcaccaccacggcggtgaccggctggcccgggatgtaggacatctcgaccctgctctggtcgcccagcgccgctccgagaagccggcagcagagtacccgcggtcgcccctcgctgcttaacaaaggccgccccgctcggcccgccccctcatgaatagttaacaaacctccagccaatcactggccggagcgccactccgctttcggaagtccctgcgcgtgcgcagaaaagcgggcagagggcggagcgtgtccggggcgcccacggcgcaggcgcggagggcggggcgggatctgggcgcgtgcgcagcccgagacctcccggcagtcttccgagcaagatggcgccgcgggcatttcttccactgcccgtctgagggaacgctaagtagtgtgtccggcgccgtgttccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatggggggccccggtggggagaaactttattttttttaaaaaaaaaacccagattcgggggaggacttgtggcca

SEQ ID NO: 353967 - DNA, 5517 bp, Homo sapiens
  misc_feature (2)..(2): n is a, c, g, or t
  misc_feature (689)..(689): n is a, c, g, or t
  misc_feature (5517)..(5517): n is a, c, g, or t
cnggcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtcngccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctcttggtttctttccttttttttttttttttttaagacaacagaattcttaatagatttgaatagcgacgtatttccgggttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 353968 - DNA, 5697 bp, Homo sapiens
  misc_feature (869)..(869): n is a, c, g, or t
  misc_feature (5697)..(5697): n is a, c, g, or t
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtcngccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctcttggtttctttccttttttttttttttttttaagacaacagaattcttaatagatttgaatagcgacgtatttccgggttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 353969 - DNA, 5643 bp, Homo sapiens
  misc_feature (869)..(869): n is a, c, g, or t
  misc_feature (5643)..(5643): n is a, c, g, or t
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtcngccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgactgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctcttggtttctttccttttttttttttttttttaagacaacagaattcttaatagatttgaatagcgacgtatttccgggttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 353970 - DNA, 1872 bp, Homo sapiens
  misc_feature (1872)..(1872): n is a, c, g, or t
ggcccctgtgacgtcgtgaacttagggatcagatcacgtaatcaacgctctgggatcgctgcaacctggcacttcaaggtaagtgcaccgataacgtctagaccggcaaacacagatctagaggtggccaactgatcactgtaggagctgactggcaaagtcaaccaggcccaaccaagagtgaccaagacaacgattaggataacccacaggcactcctcgtcataaggccaacgacacagacaggctggcaaataaagggtttaatcctaagttcagagccaggcctggctctgaacttaggaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 353971 - DNA, 2356 bp, Homo sapiens
  misc_feature (869)..(869): n is a, c, g, or t
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtcngccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataacacgttcgcgagagataacacgttcgcgagggataacacgttcgcgagagataacacgttcgcgagggataacacgttcgcgagagataacacgttcgcgagggataacacgttcgcgagagataacacgttcgcgag

SEQ ID NO: 353972 - DNA, 1987 bp, Homo sapiens
  misc_feature (869)..(869): n is a, c, g, or t
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggttctctattctcatgaaaaggtgaaaatggaaggcactatttctcaacaaaccaaactcattgattttctgcaagccaaaatggaccaacctgctaaaaagaaaaaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtcngccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgtgagtatgaaagcgggccctggaggttgtctttgtaaagggggctgacttggtaactggtgttaacgacgagaatcccattggccattttgattcccctcaggctctctctctgagggctgatggctctagactgtgtcatggccaggagtctggtggtgatgaaggcacaagcaccaaggtagcttgtgtggcatcatgatccatttagaatgtgggaatcagggatgcggtggctcatgcctgtggtcccagtgacccaggaggccaaggcaggaggatcacttgagcccaggagtttgaaaccagactgggcaagatagcaagatcccatctcttaa

SEQ ID NO: 353973 - DNA, 413 bp, Homo sapiens
gatcactgttcatcctgagaggcatgaaaggtgaatggggcgtgtgcagtggctcaagcttgtaattctaatgctttgggaggctgaggtgggaggattgcttgagcccagcagtttgaggctgcagtgagctatgatcacaccactgcactctaacctaggtgacagagcgagatcttgtctccaaaaaaaaaaaaagatgaatggctctctatgacaacgtgaacaagcttggtgacaatgttctccagggcttggctagatgctgtaggcagaagcagaacagctgtggaccttggctgccctgtgttacctctcacatccttctcttctgctctcatgtctcaggagatagagacctcagagccctgcagctgtatccacttcaccaattacagtatcctcattggaac

SEQ ID NO: 353974 - DNA, 529 bp, Homo sapiens
ctctctgaaatctcctagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctgtgagtatgaaagcgggccctggaggttgtctttgtaaagggggctgacttggtaactggtgttaacgacgagaatcccattggccattttgattcccctcaggctctctctctgagggctgatggctctagactgtgtcatggccaggagtctggtggtgatgaaggcacaagcaccaaggtagcttgtgtggcatcatgatccatttagaatgtgggaatcagggatgcggtggctcatgcctgtggtcccagtgacccaggaggccaaggcaggaggatcacttgagcccaggagtttgaaaccagactgggcaagatagcaagatcccatctcttaa

SEQ ID NO: 353975 - DNA, 5740 bp, Homo sapiens
  misc_feature (912)..(912): n is a, c, g, or t
  misc_feature (5740)..(5740): n is a, c, g, or t
atgcatgtagtcgcagtcagcgttgattattatttactcgctggcatgtcagtatattactccgttagcagctttcctccgttaaactggttcttgctttttcccttgtttcaaacttagaaataatttccatcctcatataataacctatggaagactcaccagtgacagggacttctgtatttagaaaaaagcaacctttacgttctgacctttagaactcaatattctttctccgtgaaggttcgtggacattcataaacgttgtcagcatctaacattcctaagtgtggcattatgccaatctttccaaatgtctagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtcngccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagatgtcccatacatactgaagatggaatctcacccgcacaccacctgctggcccgggagaaccctctacttgctagctcccagcttccctgacaaacagcgctgggtcaccgccttagaatcagttgtcgcaggtgggagagtttctagggaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctcttggtttctttccttttttttttttttttttaagacaacagaattcttaatagatttgaatagcgacgtatttccgggttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 353976 - DNA, 1168 bp, Homo sapiens
  misc_feature (54)..(54): n is a, c, g, or t
  misc_feature (1168)..(1168): n is a, c, g, or t
tatccccggttctgggtaacatcctcattggtgacagacttcacaacatcaggnccagtgatgaacaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaaaaaaaaaaaaaaacaaacaaaaaaacgtggtggggcgcctgcgacctggaaaaagttttccaaacccttcgtgggggcgcggcccagaggtaggtaaccatggccaaaactggtccaaagaacaccgcgcatagatcatgggtcgcgtcctcccataaaaaagcgcggcgaacggggggtcgaacaactcgagggggtctcgggcacacggtcttcaagggtccacgagtcaacaccccccgggacgcagaacn

SEQ ID NO: 353977 - DNA, 621 bp, Homo sapiens
gcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctggtcatggaatatcagcctggaggggacttgctgtcacttttgaatagatatg

SEQ ID NO: 353978 - DNA, 354 bp, Homo sapiens
ccggatgtcctggaggaggagacccaggctgagaaccagtgggtctggcagcctcctgtgtctctgcagatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353979 - DNA, 1915 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctccatttggctgcatgcagggggggcggttggggggacagaggggaggacaggggctcagccagggggaccgtgtctctttcccacgcaggacactgtgcatggggctctgggtgcatctgcccatctgtctatgggcctgtgtgtgtgtgagaggccaaacacagagagctccgtgggtctgtgtgtatccaagtgctaaaaggcaggctggctttctggggcccacagctggcgggctagtatcctggaaggtttcacttggtggcttggcctagggaccagcaagggctggggtgggaagggtggctcaaggaagcctctttctccaactccacacccctagaatccttctctcccctccagataaaaagtctcctcccctgggcatgactccccccaccccgcaagctgagacctgcaagaaggggactgcccctttgggggaggggtcgggccttggggctggtgggtgggtaagggggcctgactgaggggcagaccaacccagcctgtgtctctattgttgcctctgggattggggggtgctaaccgcttacttgctttggcctgggggtaccgcagggttcccttttccggaagccccccacagggcagacccggggagaagggcttccccaatctggcccccagccagaatacacacaagggagtggaagctaagagccgggagggggccggtgaagggagggaggaaggggaacctggctcctctcagaactgggaggcgctgctggggtcgcactgcagcagacgcacgatggacgggtcgcttttggccccgcggatgaactcctccaaggacagcttgcc

SEQ ID NO: 353980 - DNA, 1781 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctcaaaaaaaaataaatagaaaaacaaaaaaaacattttttgggcggctgtcgccctttgaaaaggttttaaaaacccaatcctggttgtggcgggcggccccacaatagagtacagagtgaacactgtgggcacatgagggtgtccccaaaagagcaactggtggtgacaatcaaagggtggggtggggattctctccccaataaaaaaacacgccggggggggacacaccacggagacgggttttgtggaaaacaacacaccacaagaaagggggggccttttcgagtaagagatggcggtctcgctcccccaccaataggggggatcctcatacaacacaagcggggtggcttcacacgggcggaagacgccttccttcacggcgcataacaaatctattaaatattactatttcaaataagcaacactataaacacatacatcatgtcatctatgctttagacagtacagcagaagttacagaatggagcagggctgtatcgaagtccaccatctgcatcctaggccgaccgcacacggcagacgccgcagtcgagtcgcttcagtcgccctctaccactcaggtgcagcatatcagtacatagctcgtcactctctgacgtgagcagtaactggtgcagttcgaaagcgaggttattggtggtcagtagacagctatgattgtagttgacgggtt

SEQ ID NO: 353981 - DNA, 1157 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccccccattctctctccactcccggagtggagagagaacggctgagggttgggggagaggcccttctctaggcagggctagactcctcggggatttaagtgctgaactgtgagagagggagaagatgag

SEQ ID NO: 353982 - DNA, 985 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353983 - DNA, 1024 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353984 - DNA, 925 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtgggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353985 - DNA, 1199 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatgtgagtacctaggcctggagtaggggcaccaggccctcgcacgggtgggaagggctcttggaatccaccctccacccccaactccagccagccatctctgccccatgccccgcagagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353986 - DNA, 1114 bp, Homo sapiens
tacaggatcttatgtgctttggacggcggaaggggaagctgttatccatacaagatgaatttagcctctgaaccccatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctccatttggctgcatgcagggggggcggttggggggacagaggggaggacaggggctcagccagggggaccgtgtctctttcccacgcaggacactgtgcatggggctctgggtgcatctgcccatctgtctatgggcctgtgtgtgtgtgagaggccaaacacagagagctccgtgggtctgtgtgtatccaagtgctaaaaggcaggctggctttctggggcccacagctggcgggctagtatcctggaaggtttcacttggtggcttggcctagggaccagcaagggctggggtgggaagggtggctcaaggaagcctctttctccaactccacacccctagaatccttctctcccctccagataaaaagtctcctcccctgggcatgactccccccaccccgcaagctgagacctgcaagaaggggactgcccctttgggggaggggtcgggccttggggctggtgggtgggtaagggggcctgactgaggggcagaccaacccagcctgtgtctctattgttgcctctgggattggggggtgctaaccgcttacttgctttggcctgggggtaccgcagggttcccttttccggaagccccccacagggcagacccggggagaagggcttccccaatctggcccccagccagaatacacacaagggagtggaagctaagagccgggagggggccggtgaagggagggaggaaggggaacctggctcctctcagaactgggaggcgctgctggggtcgcactgcagcagacgcacgatggacgggtcgcttttggccccgcggatgaactcctccaaggacagcttgcc

SEQ ID NO: 353987 - DNA, 464 bp, Homo sapiens
tggctccaagtcattcagaaatacatttagaacccaatgtccatcactagggccagggcctcagcttccccttctgcccagcaggataagccccacgcacagccctgacatagctgtcccccacaggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtatggccaggctgggagggtggttggtgggaggaggctggagggggcttgaagggtcttcaacaggtccccacccagagcctgtggtggtaagcagacagcctcaaggactaaccctttgtctgccacttaccaactgcccaa

SEQ ID NO: 353988 - DNA, 1084 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353989 - DNA, 1349 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctcaaaaaaaaacaaaaaaacaaaaaaaaccccaggggacctctataggcgagagagggcgggaaaaagggggcaacgcaaagggcactgggccaaaaggggtccccggaccacgacgtttctggtgaacaaaggggacaaatggagaggaaaaccccaaatgaggagagccgatacaaatcgcggagaagcacggttacccggggtaagagacggggacacgcaacggaacgagaacaaacagagcacacaagacagacgaggaaac

SEQ ID NO: 353990 - DNA, 891 bp, Homo sapiens
ggagggtttcacagagtgcaggcctctgacctggaaaggggtgtcccatgcataccctggcatgccccggtggccccaggatacatgaacctgcttgagacacaggcttaggagtggggactcatggaaggttgtagagagggagtgactgttttagaaacatcatgtcaggctggactatgaggaggcagatggagatgtgaggcccaggctaagcagcaggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353991 - DNA, 1059 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggctgaaggtccatggactcgggaccaggggcttaacctttccccacacagcatggtgatgagatttctgaatttaagaccggtgtccaaaaaaccaaaag

SEQ ID NO: 353992 - DNA, 949 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctaccgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353993 - DNA, 866 bp, Homo sapiens
agcggggggtcgggcggcccggggggtgacgggaagggaggccggtccggcgccgcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgggcaaggcactgctggctgcctgcacttttgggagctctgaactactggccctcgcaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 353994 - DNA, 2639 bp, Homo sapiens
ctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacaca

SEQ ID NO: 353995 - DNA, 2834 bp, Homo sapiens
ctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggagctggaaccctgaccactcttcaggaagaaaggagtctgcacatgcagctgcaccctccctccgatccttcctcccacctccccctcccccttctcccacccctgcccccacttcctgtttgggcccctctcccatccagtgtctcacagccctgcttaccagataatgctactttatttatacactgtctagggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgtctctgcctccctcaccctgagccccttccttgctctgcacccccatatggtcatagcccagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacaca

SEQ ID NO: 353996 - DNA, 821 bp, Homo sapiens
attaaactcccttatggtatagttaaagacaaactaaggctcagagaagggagttggcttgcccaatcacccagaattccaaagtcctgaatctgtagttttcccttccatcatatcatcctactcttctgccgagtcctccgtgttactccagttggatgtcatgaagccagtgtggcagtgtgaagataggtttgggacttcacttctggagcatttcatcaacataagctatcctaggcctggccagccaagcaggtcctggaggagccccaggacaaagatcacaggaggccatgaggttcggcttcttcggcgcccacagtgagcccaggaaaattagctgtagggtattacactgttgactatggagagcatatctggaattatcttcagccagattttcatctgaatggataaatgggaataccatctaagtccagataaatagatcacttccatctcatcccttctaggtagattaatcccacacttcctcttcacacaaaaccagtaataggtcatcgattttgtgcaacaggatgctgcttctcttcctaaagcccccatcgaagaggcttccagccaccattcaatcattcatcaagtcttatgatgtgccagacactgcgcgaaatgtgccagaacatctgttatgtgccagacactgttcttgagactggggatacagcaaacactcatgaagcttataattctagcagaagaggacagtaaacaatgtcatctcagtaagtatatacatgtgttttcaggattgagagctatgaaaaacataaaatatattgagaataatggttggt

SEQ ID NO: 353997 - DNA, 1994 bp, Homo sapiens
ctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactcgatggccttgcagcactcacacaggacccccttcccctaccccctcctctctgccgcaatacagatcagctcctaacccttatcaccagctgcctcttctgtgggtgacccaggtccttgtttgctgttgatttctttccagaggggttgagcagggatcctggtttcaatgacggttggaaatagaaatttccagagaagagagtattgggtagatattttttctgaatacaaagtgatgtgtttaaatactgcaattaaagtgatactgaaacaca

SEQ ID NO: 353998 - DNA, 2488 bp, Homo sapiens
ctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctgggcgaagacccttattacacggaaaacggtggaggccagggctatagctcaggacctgggacctcccctgaggctcagggaaaggccagtgtgaaccgaggggctcaggaaaacgggaccggccaggccacctccagaaacggccattcagcaagacaacacgtggtggctgataccgaattgtgactcggctaggtggggcaaggctgggcagtgtccgagagagcacccctctctgcatctgaccacgtgctacccccatgctggaggtgacatctcttacgcccaacccttccccactgcacacacctcagaggctgttcttggggccctacaccttgaggaggggcaggtaaactcctgtcctttacacattcggctccctggagccagactctggtcttctttgggtaaacgtgtgacgggggaaagccaaggtctggagaagctcccaggaacaactcgatggccttgcagcactcacacaggacccccttcccctaccccctcctctctgccgcaatacaggaacccccaggggaaagatgagcttttctaggctacaattttctcccaggaagctttgatttttaccgtttcttccctgtattttctttctctactttgaggaaaccaaagtaaccttttgcacctgctctcttgtaatgatatagccagaaaaacgtgttgccttgaaccacttccctcatctctcctccaagacactgtggacttggtcaccagctcctcccttgttctctaagttccactgagctccatgtgccccctctaccatttgcagagtcctgcacagttttctggctggagcctagaacaggcctcccaagttttaggacaaacagctcagttctagtctctctggggccacacagaaactctttttgggctcctttttctccctctggatcaaagtaggcaggaccatgggaccaggtcttggagctgagcctctcacctgtactcttccgaaaaatcctcttcctctgaggctggatcctagccttatcctctgatctccatggcttcctcctccctcctgccgactcctgggttgagctgttgcctcagtcccccaacagatgcttttctgttatgttttctccccatctttgtggttttatctacctttggtctttgattatggtgacctacagatggggttttggtgtggatgtcctttttgttaatgttgatgctattcctttctgtttgtta

SEQ ID NO: 353999 - DNA, 1532 bp, Homo sapiens
ctggagcccgaacaaacctccaccttttttggcctcgacggcggcaacccagcctccctcctaacgccctccgcctttgggaccaaccaggggagctcaagttagtagcagccaaggagaggcgctgccttgccaagactaaaaagggaggggagaagagaggaaaaaagcaagaatcccccacccctctcccgggcggagggggcgggaagagcgcgtcctggccaagccgagtagtgtcttccactcggtgcgtctctctaggagccgcgcgggaaggatgctggtccgcaggggcgcgcgcgcagggcccaggatgccgcggggctggaccgcgctttgcttgctgagtttgctgccttctgggttcatgagtcttgacaacaacggtactgctaccccagagttacctacccagggaacattttcaaatgtttctacaaatgtatcctaccaagaaactacaacacctagtacccttggaagtaccagcctgcaccctgtgtctcaacatggcaatgaggccacaacaaacatcacagaaacgacagtcaaattcacatctacctctgtgataacctcagtttatggaaacacaaactcttctgtccagtcacagacctctgtaatcagcacagtgttcaccaccccagccaacgtttcaactccagagacaaccttgaagcctagcctgtcacctggaaatgtttcagacctttcaaccactagcactagccttgcaacatctcccactaaaccctatacatcatcttctcctatcctaagtgacatcaaggcagaaatcaaatgttcaggcatcagagaagtgaaattgactcagggcatctgcctggagcaaaataagacctccagctgtgcggagtttaagaaggacaggggagagggcctggcccgagtgctgtgtggggaggagcaggctgatgctgatgctggggcccaggtatgctccctgctccttgcccagtctgaggtgaggcctcagtgtctactgctggtcttggccaacagaacagaaatttccagcaaactccaacttatgaaaaagcaccaatctgacctgaaaaagctggggatcctagatttcactgagcaagatgttgcaagccaccagagctattcccaaaagaccctgattgcactggtcacctcgggagccctgctggctgtcttgggcatcactggctatttcctgatgaatcgccgcagctggagccccacaggagaaaggctggatgctgcttctcttcctaaagcccccatcgaagaggcttccagccaccattcaatcattcatcaagtcttatgatgtgccagacactgcgcgaaatgtgccagaacatctgttatgtgccagacactgttcttgagactggggatacagcaaacactcatgaagcttataattctagcagaagaggacagtaaacaatgtcatctcagtaagtatatacatgtgttttcaggattgagagctatgaaaaacataaaatatattgagaataatggttggt

SEQ ID NO: 354000 - DNA, 839 bp, Homo sapiens
aagaaagagcatcccaggccatgggaacaacatgtgcaaaggccctagggtaggtctgagcctggaggaggagcgggtgtggcacgaggctggagagaggccctgggcaaccttttaggagatccctaaaaggggtggcctcatccagcttgctacttgtgaagctccctcaggctacactatgcgtctgtgaaagtggcattgctgccaaggtgctgggggtacctgtctccccaaggctgatcccccctcttgccctcagggccaaattctcccagatggctctgccactgaataagcattcagaagttgatcatgcacaggcccatttcattagtgctttgaaagaaaatacccttctctaagggccacccacccatggcacctacagcgtgcagatggtatgagatgaaatcctttgtcttgatcaagatcctggctctgacccttcagacaagagtccctgttgtcaagcccaggtggatgtgcaaccactgcagcttcatgatacatagcagtatgtccagcctctggtggaggaaaagcatcgtaactgcttgcacttggtgatgccttcccctcatgcacagcttgtattcagcaaaccacagactgaaggaacacctactgtgtgttgtggagcttacagttcagcaaggaggacaattagggaagtggccgccatgctgtgaggatgctcaagcagcgcctgaggcctcgtggccaggagcccgtcgctcaccacaggaagtccgagtcccggcactcgcacacgcgggacgtgagcgccgacgtgaagctcctccccttgatgcaccaggacgtggactttcttttcc

SEQ ID NO: 354001 - DNA, 445 bp, Homo sapiens
gtgcaaagacacagaggtggcgatgagcccaatctggttgggacagagtgaaaaaggggttcagctggaggggcctgagaggtgagggtggcagaacgtgtggaggtgtaagctcagcagatggtggacaccctggaggccattgtgaggctctggttctccctctgtgtgatttcaagatccattgcatggttgcagctgagaagtgaacaagccttatgacctggtttctcttgaagaggatctttccggtaggtggccttgagaaaaacacaggagggattgggaggatgtagaaattcctatttgtaagggtttgcgatctgggtatatgtccacttgagccgtgaacttactgtctcgagttctgtattctagttgggactgtttctgctaactgctgggagggtattggcacaatcacttaacgttttattcagaaggg

SEQ ID NO: 354002 - DNA, 323 bp, Homo sapiens
tctcagttcagagtcagattgtcttctctgtttgttgcaggtattgtattgcaaattccaaaattgtatcacatacccttagtcaaatatacatatgaaaatacattccagccctggcatggtggctcacacctgtaatcccagcactttgggaggccaaggcagatggatcacctgaggtcaggagtttgagaccagcctgaccaaaaaggtgaaaccctgtctctactaaaaatacaaaaattagccaggtgtggtagcaggtgcctgtagtcccagctactttggagactgagacaggagaattggttgaattcaggagg

SEQ ID NO: 354003 - DNA, 6008 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcaca

SEQ ID NO: 354004 - DNA, 311 bp, Homo sapiens
aatttactgtcttatggaaatcttacttacttgtatttatattgcctagaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttaggatataatttaatt

SEQ ID NO: 354005 - DNA, 6403 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354006 - DNA, 7810 bp, Homo sapiens
  misc_feature (1931)..(1931): n is a, c, g, or t
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttggtttgtatcatgaacattaaaatactttttttggtcatctcgaggaaagagaaatagtttattgagatagtttcttaacttatgaacctaatatatcacggttttattttaatgatataagtaatagaatatcaatgaaaaaatctgtataaaagaaatacccagtagcccataattttaccacagctgccactaactgtttggagcattttcttttaattatacttactatatgtggttagtatctttttaacttatcgattgagacaggatcttgctctgtcactcaggctgaagtgcggtcttggaatcataactcactgcagccctgaactggctaaagtagtccttccgactctgcctcccaagtagccgggactacatgtgtgtgccaccatgcccgactgattttttaatttcttgtagagatgaagtctcactatgttgcccaggctagtctcaaattccttagctcaaacctctcacctcagcctctcaaagcactgagattacaagtgtgagccactatgcctggcttgagtttttttcttttaatttttttcttttcatgaatactaccacagaatagtattttagttccctttttaaaaattatgtaatcatggtgaatattcactttggtattttgtcttttgctacctaacatattttgtcagcatttccatgctgccaagtagcctttctattaataatatcattttctgcattatgtaatgttgcccagagcatatttattgtgacccacctagctagctccttttgattggataccttggttatctctaccttttgtagccaagttctttaaaagtctgttagtatccagggtaatttcttttcttagttggccactgccctccctttttcaataggtggatgagaaaaaagtatattggatcgctatgattgccagtaattcatggtgatctttaagaaatatattttcatcaaatttttttaaaacctttgtcagatttcttagtttaggtgtatgtggaggtggaattaatctatacttgcacttattcacagaatttataaagataaaactgttctatgttgacgaatccatttgcaaaaaaagcacactttcaaattgttcttctaatattaatgaggagagctttcaaattgatgtatttgccagtaccacagcgtagtggctgagagcctgtattctggagctggactgcctgggctggaacccgggctcctccacttccttgctgtgtaccttagtttctcatctgtaaatggtgttgatnatagtagctgttttgtagggttgtcatgaggattaaacaagttaatactttagccctttataagaatagtatctgacatattttcttagtttcatactctatatgttttgatcttttccagagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354007 - DNA, 6350 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaaccccatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354008 - DNA, 5084 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttaaaaaaaaaaaaaaaaaaaaaaaaaaaaaaaaaaaaaaaaaaaaaaaaaaaaaaaaaaaaaaaaaaaaaaaaaaaaacacaaaaaagagaaggaacaaaaaaaaaaaaaaaacagaaaaccgagcaacaaagggacacaaaaaagaagccaaaaaaaaaagaaacacacaacggcacaaaacaaaaaaccaacacacaagaagacaacaaggaaacacgacaacaccacagaaaaaaaagaaataaaaaaagacaacagaaaaacaaggacgaaaacaaacacaagcaatagaagagacaccaggagggcacacacgacacacgacagagaagagaaacaaagtgagcacacaaacaagacgaaagcaaacagaaacaagaacagcaaactgtggcacacaaaaccagcaagcaaacatacaagaaaatacgccccgcggagcagacagaacaagaagaaaaggagagagggacaggagagaggagagccagcgagcaacagagaggaagagcaagaggacggcagagggagaaaggaagcgacgaccaagagaaagagaaaaccgaaagaagcgcagtaaggagagaagagaagagcaaagagaaagagaaggaaagagacagaagagaggcagagcgagaagggaaagaagacggagggaggagaaggagaggacaagcgaagagagcggagacaagaaaacaagacagagagccgcg

SEQ ID NO: 354009 - DNA, 3950 bp, Homo sapiens
ataaataatgtaaatctacctctagtggctctggtatttttaaacttatttatagctggcaaagtacttttttgtatgtatttttatagcaccattgcacttctcatgtttgttgcaagcatctcccacagcttcctttgtcttttaattttatgacatataaataaaagtatacatttcaatatggccatattgattgtgaatgttcgattgtgatcttgtaatttatatttaaaagtcatttcccaggctaaggccacctctattttcttttagttttttaaaatggtttcattgttttatatttgcctatgatccagacattagtaactgtgggttcttaattgggcttcagagaatctgagaattccttaaaattctctacataattgtacatgtacttaatacatgcttttttccatgttaagagtccagagtttttgttagatcctcaaaggggtcagtcagtctctcctcccacttccaaaaaatgtctgagacctactactataatccatctggactttatttgggtaaaaggtggtatggtgagactcatatttttctttttcccgcaaatagttaagtataccaaccatttagtaaataattacctcctgatttgtgatacctttgaaaaataaatgtttttctttatttttatctccacagagagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354010 - DNA, 3296 bp, Homo sapiens
  misc_feature (1)..(1): n is a, c, g, or t
ntggggaagccccagaagtaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354011 - DNA, 3300 bp, Homo sapiens
cccgaagattccatgatagatagcagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354012 - DNA, 3316 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggata

SEQ ID NO: 354013 - DNA, 3725 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcactcggactcaacactacacaccaggccaccacatggcgccgcacccagcattgacacttcttttaccttgtctgggctctgacatccgtgccaggttgctcttcgtcatggagtcccttttactgagctctgctctgacgctttgtgccaggtgcctctccatctcatccttcccacccgctagcctctgcccgaccccagacagattccttcctcacctgaagccagaccatgcctttgtggagataccctctttaccctgcctgtgcttcgccagcctgcaccaggccaccctcctgcacagatactctcctcagtactggaccaggctaccaacagccccatgtgaacccattgtaacccaggtcaggcattaacacctgcagtaggctaccatggcttccccttcccacccccctagcttggccctactaataatcactttgtcactgtttggggttgatatttggttgtttcttgtaggttcctagctttaagataggattgcatactaaaatttacttagatctttgagaactcaaggaaatcagtgaaacattattgttattaaataaaaataaaatacctgtagttggta

SEQ ID NO: 354014 - DNA, 3361 bp, Homo sapiens
  misc_feature (1931)..(1931): n is a, c, g, or t
  misc_feature (2240)..(2240): n is a, c, g, or t
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttggtttgtatcatgaacattaaaatactttttttggtcatctcgaggaaagagaaatagtttattgagatagtttcttaacttatgaacctaatatatcacggttttattttaatgatataagtaatagaatatcaatgaaaaaatctgtataaaagaaatacccagtagcccataattttaccacagctgccactaactgtttggagcattttcttttaattatacttactatatgtggttagtatctttttaacttatcgattgagacaggatcttgctctgtcactcaggctgaagtgcggtcttggaatcataactcactgcagccctgaactggctaaagtagtccttccgactctgcctcccaagtagccgggactacatgtgtgtgccaccatgcccgactgattttttaatttcttgtagagatgaagtctcactatgttgcccaggctagtctcaaattccttagctcaaacctctcacctcagcctctcaaagcactgagattacaagtgtgagccactatgcctggcttgagtttttttcttttaatttttttcttttcatgaatactaccacagaatagtattttagttccctttttaaaaattatgtaatcatggtgaatattcactttggtattttgtcttttgctacctaacatattttgtcagcatttccatgctgccaagtagcctttctattaataatatcattttctgcattatgtaatgttgcccagagcatatttattgtgacccacctagctagctccttttgattggataccttggttatctctaccttttgtagccaagttctttaaaagtctgttagtatccagggtaatttcttttcttagttggccactgccctccctttttcaataggtggatgagaaaaaagtatattggatcgctatgattgccagtaattcatggtgatctttaagaaatatattttcatcaaatttttttaaaacctttgtcagatttcttagtttaggtgtatgtggaggtggaattaatctatacttgcacttattcacagaatttataaagataaaactgttctatgttgacgaatccatttgcaaaaaaagcacactttcaaattgttcttctaatattaatgaggagagctttcaaattgatgtatttgccagtaccacagcgtagtggctgagagcctgtattctggagctggactgcctgggctggaacccgggctcctccacttccttgctgtgtaccttagtttctcatctgtaaatggtgttgatnatagtagctgttttgtagggttgtcatgaggattaaacaagttaatactttagccctttataagaatagtatctgacatattttcttagtttcatactctatatgttttgatcttttccagagaaaaattagaaaagcccttcctagttcagaagaccttgtaaagttagcaccagactttgacaagattgttgaaagccttagcttattgaaggacttttttacctcaggtaaggaagaagctgtttgatctaatttaaaaatttaagaaccatggaggaaaaatacatggattatttgtttattccnatttttttaaaattaaaatatttagtaccaatgaaaaacaggacattttttaaaaagataaacacaaagttttgttacacaatggttttaatctttgtgtagcccagtaaaatgacagttcctaagcacttaaacatacttggcttttagtgaggggaaaaaatgtatcacttgttcttgacaagtagatgagacttcctatgtatttgcttttcataagtggttggaccaatttggtggttttaaaacaaatttaagtatgatagaccataatgagtagcatttattaagtttaatcctggcatatttgcccaattattgccctatcgtaatatgaaatctgagatctcagacatctttgtttgctcatttctgttaaattttacatttctatttccccttttgctgatttttcacaggtcacaaattggttagtgaagtcataggagcttctgacctacttctcttgttaggtgtgtaaacagacatttttgctgaccttaacatgccttttaaatgcttctaataaactagttgcaaataaaattgcagaccaaatttataatgctgcttatgctgaattttaaaaccccagaactatattaggcaaactcattatcctttaggtggaaataataaaataattattttgtgataacactaaaattcttaaatatgtatgtgtattataagattaaagctattaaaagaaaatttacttagcaaaaatattttcttgaaatagatctaattgtttttgataattgaaatgaaaagtaattttagtttgtctcatctgccctgtcatggttgacatttaaatttgttttccggccgggcgcggtggctcatgcctgtaatcccagcattttgggaggccagggcaggcggatcatgaggtcaggagatcgagaccatcctggctaacacggtgaaaccccatctctactaaaaatacaaaaaatttgccgggcgtggtggcacacgcctgtagtcctagctactcgggaggctgaggcaggagaattgcttgaacccgggaggcggaggttgcagtgagccaagatcgcgccactgcactccagcctgggcgacagagggagactctgccccccaccccc

SEQ ID NO: 354015 - DNA, 862 bp, Homo sapiens
  misc_feature (1)..(1): n is a, c, g, or t
  misc_feature (6)..(6): n is a, c, g, or t
  misc_feature (9)..(9): n is a, c, g, or t
  misc_feature (15)..(15): n is a, c, g, or t
ncaccnggnggcttncggtctagaactcccggattctccgggctgcatgaattcggcacgttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354016 - DNA, 3257 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttggtaataaatactgctgagaagcaggaatctgcttccttaatatttgtttcttgcagtaaatgttactacatgtgttagttagatatttaagtgcttaatttgacttttgtcacgtgtacatttgctgacagtaaaagcttagtcattttgattgcgtgaagagaaggaattttattctcagtattgcttttttaagagtaatgctttaatttgtaaatggagaaatttactttggcaagttcaatggtcaacagtcagttcatgcaaaatgggatgaaaccgacctagacctttgccccacgtcacgctgtttcagattgcaaaatagaatttctgtttaaaaatggcatatatatgtgtttttgtgtgtggtttacagtcaaatgtaactcaattagatgtgagtggattcagaaaaaataaaaatgttgtttttattaaattggatatga

SEQ ID NO: 354017 - DNA, 2609 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggataggatcctctataacgagcgcagcac

SEQ ID NO: 354018 - DNA, 1853 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagacataggggtcctctagatcccccggct

SEQ ID NO: 354019 - DNA, 344 bp, Homo sapiens
ttaggcgattagagaaaaatgttaaagaggtattggaagattttgctgaagatggtgagaagaagattaaattgcttactggtaaacgcgttcaactggcggaagacctcagtgagtagttcttactgccctctaccttactacctttccacctttcccatttccatttgtttgttgatccatttaatctcaaacttacagaaaagttacaaggaactgggctgagcacggtggctcacgcttgtaatcccagcactttgggaggccaagatgggtggaaaacaaggtcagaagatcaagaccatcctggctaacacagtgaaaccccgtctctactaaaaata

SEQ ID NO: 354020 - DNA, 6349 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354021 - DNA, 4056 bp, Homo sapiens
tggggtgcctcaaacgggtagagcgatgagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354022 - DNA, 5843 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagta

SEQ ID NO: 354023 - DNA, 4057 bp, Homo sapiens
ggcggcgcgtgtacacccaggaaacactatacctatgcgatcacggtccggacgatctacacccgggagacagcgatgacagtattaagggatctacacgtgggagtgacttgacggcgcgcagctcggagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttccacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttca

SEQ ID NO: 354024 - DNA, 5220 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtgggaaattgatgagtatatcgattttgagaaaaattagaaaagcccttcctagttcagaagaccttgtaaagttagcaccagactttgacaagattgttgaaagccttagcttattgaaggacttttttacctcaggttctccggaagaaacggcgtttagagcaacagatcgtggatctgaaagtgacaagcattttagaaagggtctgcttggtgagctcattctcttacaacaacaaattcaagagcatgaagaggaagcgcgcagagccgctggccaatatagcacgagctatgcccaacagaagcgcaaggtgtcagacaaagagaaaattgaccaacttcaggaagaacttctgcacactcagttgaagtatcagagaatcttggaacgattagaaaaggagaacaaagaattgagaaaattagtattgcagaaagatgacaaaggcattcatcatagaaagcttaagaaatctttgattgacatgtattctgaagttcttgatgttctctctgattatgatgccagttataatacgcaagatcatctgccacgggttgttgtggttggagatcagagtgctggaaagactagtgtgttggaaatgattgcccaagctcgaatattcccaagaggatctggggagatgatgacacgttctccagttaaggtgactctgagtgaaggtcctcaccatgtggccctatttaaagatagttctcgggagtttgatcttaccaaagaagaagatcttgcagcattaagacatgaaatagaacttcgaatgaggaaaaatgtgaaagaaggctgtaccgttagccctgagaccatatccttaaatgtaaaaggccctggactacagaggatggtgcttgttgacttaccaggtgtgattaatactgtgacatcaggcatggctcctgacacaaaggaaactattttcagtatcagcaaagcttacatgcagaatcctaatgccatcatactgtgtattcaagatggatctgtggatgctgaacgcagtattgttacagacttggtcagtcaaatggaccctcatggaaggagaaccatattcgttttgaccaaagtagacctggcagagaaaaatgtagccagtccaagcaggattcagcagataattgaaggaaagctcttcccaatgaaagctttaggttattttgctgttgtaacaggaaaagggaacagctctgaaagcattgaagctataagagaatatgaagaagagttttttcagaattcaaagctcctaaagacaagcatgctaaaggcacaccaagtgactacaagaaatttaagccttgcagtatcagactgcttttggaaaatggtacgagagtctgttgaacaacaggctgatagtttcaaagcaacacgttttaaccttgaaactgaatggaagaataactatcctcgcctgcgggaacttgaccggaatgaactatttgaaaaagctaaaaatgaaatccttgatgaagttatcagtctgagccaggttacaccaaaacattgggaggaaatccttcaacaatctttgtgggaaagagtatcaactcatgtgattgaaaacatctaccttccagctgcgcagaccatgaattcaggaacttttaacaccacagtggatatcaagcttaaacagtggactgataaacaacttcctaataaagcagtagaggttgcttgggagaccctacaagaagaattttcccgctttatgacagaaccgaaagggaaagagcatgatgacatatttgataaacttaaagaggctgttaaggaagaaagtattaaacgacacaagtggaatgactttgcggaggacagcttgagggttattcaacacaatgctttggaagaccgatccatatctgataaacagcaatgggatgcagctatttattttatggaagaggctctgcaggctcgtctcaaggatactgaaaatgcaattgaaaacatggtgggtccagactggaaaaagaggtggttatactggaagaatcggacccaagaacagtgtgttcacaatgaaaccaagaatgaattggagaagatgttgaaatgtaatgaggagcacccagcttatcttgcaagtgatgaaataaccacagtccggaagaaccttgaatcccgaggagtagaagtagatccaagcttgattaaggatacttggcatcaagtttatagaagacattttttaaaaacagctctaaaccattgtaacctttgtcgaagaggtttttattactaccaaaggcattttgtagattctgagttggaatgcaatgatgtggtcttgttttggcgtatacagcgcatgcttgctatcaccgcaaatactttaaggcaacaacttacaaatactgaagttaggcgattagagaaaaatgttaaagaggtattggaagattttgctgaagatggtgagaagaagattaaattgcttactggtaaacgcgttcaactggcggaagacctcaagaaagttagagaaattcaagaaaaacttgatgctttcattgaagctcttcatcaggagaaataaattaaaatcgtactcataatcagctctgcatacatctgaagaacaaaaacatcaacgtcttttgtccagcctctttttcttctgctgttccacctttctaaacatacaataaagtcatgggataaaaataatcgatgtatgttacgggcgctttaaccatcagctgcctctcgaatggaagaacagtggtaatggattaacatcctattttgttgtactaaagtgacaaatcggaataatataattggtatggccattaggttcagtccttgaagataagaagcttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccctaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgctactccccattttattgttttacatcaatgcatgcttcgttgtgatccctcaagatgtaacacttggtatgctcggttgaggatatgaaaaaatacttccgaaaccaggaattcagtgtatgtttgttttatactgtttgataagaaaagtaggtccagccttaagcagcacagatgcgctggtagatgcatagtcaggaactttttttatttcttttaggtctagggacaggagtgaatagaaagggaggagagctctattatgttctatacacagattaggagatgaccttactgggtacacccctctaaccagtgcttacaggttaatgcatgttaatgaatatttttgcagttgtaaagcataacaattacaactacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagta

SEQ ID NO: 354025 - DNA, 846 bp, Homo sapiens
gtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctgtgaggtctgccagtctttagtgaaacacagctctggaataaaaggaagtttaccactacaaaaactacatctggtttcacgaagcatttatcattcacatcatcctaccttaaagcttcaacgaccccaattaaggacatcctttcagcagttctcttctctgacaaaccttcctttacgtaaactgaaattctctccaattaaatatggctaccagcctcgcaggaatttttggccagcaagattagctacgagactcttaaaacttcgctatctcatactaggatcggctgttgggggtggctacacagccaaaaagacttttgatcagtggaaagatatgataccggaccttagtgaatataaatggattgtgcctgacattgtgtagcaattgtacgttctagttctacatcacggaggaggcgtgcaggcgttgtgcgtagaggatcctagaccagcatgacagctgtttcaaggacacagggaaagcgagtggttggtgaaaatccgtgagcgtcggcaatatagttgtttttctggaacttacttatggtaaccgtctattatttatttttctaatatatatgggggagtttcgtactgatacgtagcaa

SEQ ID NO: 354026 - DNA, 262 bp, Homo sapiens
caagctgaactcaaactcctaggctcaagagattctcccacttcagcctcctgaaaagctggcactacaggtgcgcaccactgggtccagcataatggctatttcttgacaaatcttgacaatgccaccagtatgtttttctttagagacagagtctcgcttcgtagcccaggctggagaacagtggtgtgatccctagctcactgcagcctcaaacacctggactcaggagatccccctgcctcagcctctcaagtacctg

SEQ ID NO: 354027 - DNA, 508 bp, Homo sapiens
ggtttgttttttgttttaacttccaaactaaaacccctgatgatttcagaacactgtaacactggacagtttctcacagcatggttgtgaggatgaagtaaaaagagaatgtaaagaataagtgttttctttgtaagtgtggtcccggtatcacttatgcatatgcatgtccctctgtataaagaagggtttaaactctcgaagtcacctataattgcagttaccctttcgtctgcccactcttgcattttctctgcctcttggccaaggcagtgacttggaggaaattcacttggtggaagagatatggaggtgagaaatcggactgagtagaaggcatcttacattacacgcagaaattaaaaagcacttacttagtatcggggaccatacgctggcatagttctgtgttagctcattcccacttatgtaagtcgccccaagcagagcgtaaaacattaagtaaccttctcctcccttttgtctttcagattcctttgtgacactg

SEQ ID NO: 354028 - DNA, 330 bp, Homo sapiens
taaaactcagacactgcaaacttgtccaggaagcctctctggaatcccccaacccagctggagtaagtacctctcctgtgctctccagtgcctcagactccccaccattgtgacaccaactctgcctgctgaatctgtctctgtaatcctaccctcaatatctagcatgggccccatgaggcatcagattttgttgaaagaataaatgaggctgggcacggtgggtcatgcctgtaatcccagcactttgggaggccaaggcaggcggatcacctgaggtcaggagtttgagaccagcctggccaacgtggtgaaaccccgtctctacta

SEQ ID NO: 354029 - DNA, 405 bp, Homo sapiens
gctgaagatgcttttaaaaccttctagttacttagagcagactatatggcgcagcttggtggttctaaaaggcaggtcctatccatcacagaaacagcaagtctctgggttatgggggaagattgagcgggggggagtgaagtaaggagaaaggggggctgttgtgtccagtttacatttgtcaccagtgactagcttttaaaaaatgtattagctgtgcatggtggtaagtaagatccagctgcaggggattatggctttgagtgggtcggggagcttggaatgcattcagttccatcaggggatttgtgtccctcgtcatcagccttaacattgctaacacagtaaagattaggaacagaccagtgtcacctgccctgaactttgaaaaaccctggaaccatt

SEQ ID NO: 354030 - DNA, 909 bp, Homo sapiens
cttctcagcccaggattatgacatcttcgcccctattttacctgtggagaagcagaggctcagggttacccaggaagtcagggcagggttggtgctggtgctgaagattagacctcagaccaactcttgtatcctgcctttgccccactccactggttctataaatagcgaccatgtacctactaaatagcgggccccgcggtgattaccctgtgatccttgtgatgcttgagtagctgacttagggcatcctcagcaccgatgggctggtggtttcccctgactcgggcctccttgcagtacctctttttaccaccaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcc

SEQ ID NO: 354031 - DNA, 2719 bp, Homo sapiens
  misc_feature (19)..(19): n is a, c, g, or t
  misc_feature (28)..(28): n is a, c, g, or t
tcaggctggttacggtccnaggtcgtanatcggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354032 - DNA, 2560 bp, Homo sapiens
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcc

SEQ ID NO: 354033 - DNA, 3100 bp, Homo sapiens
  misc_feature (2618)..(2618): n is a, c, g, or t
  misc_feature (2622)..(2622): n is a, c, g, or t
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcaaaaaaaaaaaaaaaaaaaaaaaaaaaaaaaaaaaaaaaaaaaaaaaaaaaaaaanaaanaaaaaaaaaaaacaaaaaaaacaaaaaacaaaacaacaacaaaaacaaagagaggggacgcagacccaaaaaaaaaaaacacaacaagaccgcgagacaggacgaccaacaccaccacccacaccgatcaacaacaatgaaagaaaagaagaccaagccgactacattaacgagacgacgctaacaaacaacagcaaagcgagacggaaccgcaaaaaagaaaaacaagcagcgacgaagcaagcaacaacaaaagacaaaccagccaaacaacgcagagaacagacaacaaactacgcaagagagacaaaacaaccacaagcgcgagacaccaaccgcaacagacaaatagaaaaacgcgacgacaggaaacaccaaacaacgaccgacgagccagacaacgacagaccaggcactgacagctagctcgcacacaaaaagcgccacaagaagtcacccacaacacacaacacagcgc

SEQ ID NO: 354034 - DNA, 2668 bp, Homo sapiens
cctggtggcgaattcggcacgaggttcctttccagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354035 - DNA, 3104 bp, Homo sapiens
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtccgacttccaacgtgactcagacttccagggatcccggggagggttggctggagcagccccacacctgcccaaggagccccaggactctgtgaccaactgggggtgaccctgaccctccagtctctgtctctagggctgtttttaggtagtacagagtgccctgcctccaaatcccacagcccttgtcccagtcttggtgtatgcccagcctgagtctgggtgctgacctgggattactgtttgcccttgtccttatccccacagtagtcttgggtcctccccagggttttctgttcacccatggtccctgccccgcctcactccaagctcagggatgcctctgattgctgggccctacctgtcccctgccctccagatgacggcgctaatattgtatccctcccctcttatctggccccggagactttctgcctcatcccagctacttccatcgtatgtctcccgggcccctgcttggaacttgggttcccccacacacacctgcagtccccaagctgcatccctgtgtccctgcctgcaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcc

SEQ ID NO: 354036 - DNA, 2331 bp, Homo sapiens
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgtgccatgcaccggtctgtccctgcaccccatggcacccaggatctggtctcggtggtccttccccgcaggcaggtgtcaggaccggcctaataaacatgtgtggcctcc

SEQ ID NO: 354037 - DNA, 2456 bp, Homo sapiens
cgcggggctgggcttaggccgagccccaggatttcaaatgctgacaaacaccaaacacgctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354038 - DNA, 2905 bp, Homo sapiens
  misc_feature (19)..(19): n is a, c, g, or t
  misc_feature (28)..(28): n is a, c, g, or t
tcaggctggttacggtccnaggtcgtanatcggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacaggcagtgcgctggacacgcagatgcgcttgggagccagcggtccctgccttggctgcttgtggtctgatggagcagttgaggcacagtggtggcagctggctaagcacctgcggcctgcttcggatctggactaattctgagggccggctctcctgggcaccagggttagggggttacggggagtatacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354039 - DNA, 3025 bp, Homo sapiens
acgcttttatgcatgtctcaagtttcccaaaacggaggcagtgtgaacacagtctacagatgaagaactggggctcagaaaagttgaggggcgtggtctagatttacagcaagtcttaggcagatgagagatgaggacccagctgcatagctggaaggcattcccagtcccagctactcaggaggctgagatgggaggattgctggaccccaggagtcccaggctgcagtgaactatgatcatgccactgtactccaagctgggtgacagagaaaaaaagaaaagaaaagaaaaagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggtgggcgctgccgggcagggcctgcagtgggcctttcctggggctctggggctaacgtcaccctccgtcccccaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354040 - DNA, 1336 bp, Homo sapiens
ccacgtcagggaagctgctccggggtacttagaatgtaggatgatgctgtcccttgcagagggggctggggcacttagagccccagcagagggtcattaacagccttacctggaagaggggacctgctgtggacctgggcaccttctcttgcagggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354041 - DNA, 1088 bp, Homo sapiens
tattgtcctcagccctttctatctcagtcctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354042 - DNA, 1066 bp, Homo sapiens
cttctcagcccaggattatgacatcttcgcccctattttacctgtggagaagcagaggctcagggttacccaggaagtcagggcagggttggtgctggtgctgaagattagacctcagaccaactcttgtatcctgcctttgccccactccactggttctataaatagcgaccatgtacctactaaatagcgggccccgcggtgattaccctgtgatccttgtgatgcttgagtagctgacttagggcatcctcagcaccgatgggctggtggtttcccctgactcgggcctccttgcagtacctctttttaccaccaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354043 - DNA, 671 bp, Homo sapiens
ttgcagctcgaccccgttgccgctagaggcccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354044 - DNA, 960 bp, Homo sapiens
  misc_feature (19)..(19): n is a, c, g, or t
  misc_feature (28)..(28): n is a, c, g, or t
tcaggctggttacggtccnaggtcgtanatcggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgccgtcgcctacgcagtgcgtaggcgacggcgccaggggacccaggaagaacttcgtctccttcactcacctggtccccttcttgttgggcactgtgtatgggcggagaaaatccagcttgttcttgctgatgacgcagaggtcaatgttgcttccggagcccaggtcgttgaagatgccagctgcgatggcttcgctcaccagattcttggcttcctcctcctgagaaacagaacggcggcaataatgtccccggccaaactaggcctgctccgtgacatccagcaatgtacgtccactaacagtgcgt

SEQ ID NO: 354045 - DNA, 633 bp, Homo sapiens
  misc_feature (19)..(19): n is a, c, g, or t
  misc_feature (28)..(28): n is a, c, g, or t
tcaggctggttacggtccnaggtcgtanatcggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccaatccgggacacgaatcgcaaacggaaaaccggaattttttcccccgcggaacaaggcaatgggcgcagggggcaactttgcaagcaacttggggaacccggggggccttgggggccctaatcccaaaatccatttgcggacaaaggttgcaattccaaccccggaacgtttctca

SEQ ID NO: 354046 - DNA, 481 bp, Homo sapiens
agggttgtggcttgatggcatggtcttcctagaagccggggttttgaagagaggagatctaggcatgatttagaagcatgaagggaccaggctcccaggcacctggtgtgtgaaaggaaaaacagcctccctaggcaggattctatcaggaccaaagggaaagggcccttcagagaagacagcccatgttccggaaagcatgtgaaaggctttgggaggtctggaaaggagatgagggtcaacaagaatgtattgcctcatccaggcagtgcgctggacacgcagatgcgcttgggagccagcggtccctgccttggctgcttgtggtctgatggagcagttgaggcacagtggtggcagctggctaagcacctgcggcctgcttcggatctggactaattctgagggccggctctcctgggcaccagggttagggggttacggggagtatgtgagtaacgcctgctttgggaacataaac

SEQ ID NO: 354047 - DNA, 848 bp, Homo sapiens
ccacgcgtcgcggacgcgtgggtccagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcc

SEQ ID NO: 354048 - DNA, 2717 bp, Homo sapiens
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354049 - DNA, 2689 bp, Homo sapiens
cctggtggcgaattcggcacgaggttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354050 - DNA, 2950 bp, Homo sapiens
acgcttttatgcatgtctcaagtttcccaaaacggaggcagtgtgaacacagtctacagatgaagaactggggctcagaaaagttgaggggcgtggtctagatttacagcaagtcttaggcagatgagagatgaggacccagctgcatagctggaaggcattcccagtcccagctactcaggaggctgagatgggaggattgctggaccccaggagtcccaggctgcagtgaactatgatcatgccactgtactccaagctgggtgacagagaaaaaaagaaaagaaaagaaaaagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354051 - DNA, 3261 bp, Homo sapiens
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtccgacttccaacgtgactcagacttccagggatcccggggagggttggctggagcagccccacacctgcccaaggagccccaggactctgtgaccaactgggggtgaccctgaccctccagtctctgtctctagggctgtttttaggtagtacagagtgccctgcctccaaatcccacagcccttgtcccagtcttggtgtatgcccagcctgagtctgggtgctgacctgggattactgtttgcccttgtccttatccccacagtagtcttgggtcctccccagggttttctgttcacccatggtccctgccccgcctcactccaagctcagggatgcctctgattgctgggccctacctgtcccctgccctccagatgacggcgctaatattgtatccctcccctcttatctggccccggagactttctgcctcatcccagctacttccatcgtatgtctcccgggcccctgcttggaacttgggttcccccacacacacctgcagtccccaagctgcatccctgtgtccctgcctgcaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354052 - DNA, 2863 bp, Homo sapiens
cctggtggcgaattcggcacgaggttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaaggtgtgtgcgcacggggagtgggggggtgcggggaggggggaagggaaccaggcccctgctatattgctcccccagatcatgcctccgactttttgtgaggttcaggagagcaggtgttcataagaggacgaacctcggccagggagtacgagcagctgaggcgtctgaggggatctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354053 - DNA, 2349 bp, Homo sapiens
cccccccccccaaccctacggctagtacgagcctggtttaatcggccgagggagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaagagggtgttcgcaaggcccagagcagcgactccagcaagaggactttctccgtgtacagcagctctcggcagcagggccgctacgcccccagctatacccccagtgccccgatggacaccaacctcttgagcaatatccagaagctattctctgaacgtattgatgtgttcagccctgtggagttcaacaaggtgtcggtgctgaccggcatcatcaagatcagcctgaagacgctgctggagtgtgtgcggctgcgcacctttgggcgcttcgggctgcagcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagag

SEQ ID NO: 354054 - DNA, 1971 bp, Homo sapiens
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggcggctcaggcgccccggagcaggcagagtgcgtggagctgctgctggccctgggcgagcctgcggaggagctgtgcgaggagttcctggcgcacgcccgcggccggctggagaaggagctgagaaacctggaggccgagctggggccctcacctccggctcccgacgtgttagagttcaccgaccatggaggcagtggcttcgtgggcggcctctgccaggtggcggcggcctaccaggagctgtttgcggcccagggcccagcaggtgccgagaagctggcggccttcgcccggcagctgggcagccgctattttgcgctggtggagcggcggctggcgcaggagcagggtggtggtgacaactcactgctggtgcgggcgctggaccgcttccaccggcgcttgcgggctcccggggccctgctggccgctgccgggctcgcagacgctgccacggagatcgtggaacgagtggcccgcgagcgcctgggccaccacctgcagggtctccgggcggccttcctgggctgcctgacagacgtccgccaggcgctggcagcacctccggctcccgacgtgtcagagtacaccgaccatggacgcagtgcgctacgctgggcggcctctgccaggtggcggcggcctaccaggagctgcccgcggcccaccggcccagcacgctgccgagaagctgcgcgagacatacgcccggcaacctgacaaagaccgcatacactagcagctgcctgcaacaagacaaacaagaaaccaacgtacaggaaacctggccacatcgagaccaaacaaccacagcagacacagcgaaaactaggaaaagcccaaactaggagcaaagagccgcgaagacaggcgaaacccaacaggaaacccagaagacaccccaagggacacgccaaccaacagacaaacgcacacagaaaaccccgcaaggagccaaaatgcccaaacacaaaggcacaataccacagccacggcccccaaaatccgcaaacgcgaaaacggaaaccccacgcccccacaaagaggaccacaaataccaagacacaaggacacaccccagagaaccccacccgaccacaccaccccacaaaggaccaaaaaacggccgacggagcacacagcacgc

SEQ ID NO: 354055 - DNA, 1143 bp, Homo sapiens
  misc_feature (867)..(867): n is a, c, g, or t
  misc_feature (870)..(870): n is a, c, g, or t
  misc_feature (873)..(873): n is a, c, g, or t
ctcgtttcaacaacaactttatggctcccggaagtgcctcctccccgtccccttcctttccagcctcacgcccgtgggctgcagttggaacgatggcggcggcagctgccgccgggcctagcccggggtctggacctggggactccccagaagggcccgagggggaggctccggagcgtcggcggaaggcgcacgggatgctgaagctttactacggcctctcggaaggggaggcggcgggacgccccgcggggcccgaccccctggacccgactgatctgaacggggcgcacttcgacccggaagtttacctagacaagctgcgtagagagtgccctctggcccagttgatggacagtgagacggacatggtgcggcagatccgggctctagacagcgacatgcagaccctggtctatgagaactacaacaagttcatctcagccacagacaccatccggaagatgaagaacgatttccggaagatggaggatgagatggaccggctggccaccaacatggcagtgatcaccgacttcagcgctcgcatcagcgccacgctgcaggaccgccacgagcgcatcaccaagctggcaggggtccacgcgctgctgcggaagctgcagttcctctttgagctgccctcgcgcctcaccaagtgcgtggaactgggcgcctatgggcaggcggtgcgctaccagggccgcgcgcaggccgtgctgcagcagtaccaacacctgccctcgttccgcgccatccaggacgactgccaggtcatcacggcccgcctggcccagcagctgcggcagcgctttagggagggggtcaggcgcccggagcaggcaatgcgtgagcgtgtggcctggnganccnggagagcggccagaagcctagacacgccggcagtggaacagccagaaacccggggcacatggggccaaacaggcacaaaggtgaggctccggcctgagagcagcggcaaggagacaactaacgagcgggacacagacgcagtgacggcgcaaagagcaaagagggcacagagaagacaacacagaagagagcaacggagaacctagcaggagaccacgacaagaatgaagaagcaacaagagacgacgcagcacagcgagcgcgagagaa

SEQ ID NO: 354056 - DNA, 367 bp, Homo sapiens
atacagcatctgttcagggaaaggaggctgttctgttggatcaaagaacatcttacgtgtcagaaaaaagcaggagatggatatgggatcagaagaactggattctagccccagtcagccctagcttgttgggtgagctagagccagcccttccctccctgtgcctcagagcccttctgtgtacactggggatggtggaacatgccatcccgagagctctgtggtctgtccactcaagacagcagactggggctgttgttactgctattattactgtcattgctcttgttcttactgctgaccatgatgtcaagtctctgtcaactcagctcagaaattcttactgtgacctccaatgtggtgttga

SEQ ID NO: 354057 - DNA, 1100 bp, Homo sapiens
aaatagcctgataaataactagacagtctttgcactcgagagattccacaacatgtaatgcaataatggaaaggtttaccttctttagcttcaaagttggagggatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354058 - DNA, 2575 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354059 - DNA, 2424 bp, Homo sapiens
attccccctacattaatttataaatttaatgcagtacaaaaaaataccaacaaacatttctctggagttagtcaagttgataataaagttcacatagaaaagcaaacatgcaagaattattaatggaagtccttttctttaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354060 - DNA, 2403 bp, Homo sapiens
  misc_feature (30)..(30): n is a, c, g, or t
  misc_feature (32)..(32): n is a, c, g, or t
  misc_feature (47)..(47): n is a, c, g, or t
  misc_feature (51)..(51): n is a, c, g, or t
ggtggaagagagagagagggagattaggcnangtacgaggctggtgntgantcggccgaggctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaagttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354061 - DNA, 2481 bp, Homo sapiens
gcatcaaaaagctttatttccatttggtccaaggcttgttaggatagttaagaaagctgcctattggctggagggagaggcttaggcagaagccctattactttgcaaggggcccttcagaagtcgctgggctcagaaggctcttagtcgtgcttgagagtgagcctttcgaagagatactcgcccagcccagcctccgggccacccagcctgtggaggttggtcaggtggtcacccatcttcttgataagcttcacttcctcatctaggaagtgagtctccaggaagtcacagagatgggggtccgtgcgggcagaacccagggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354062 - DNA, 2554 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgtgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354063 - DNA, 2521 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354064 - DNA, 1597 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggaatttcctcctgaaaagtttcttacttgctacctactacctacaaaggaatgatatggtacagtaccggaagtatgtagt

SEQ ID NO: 354065 - DNA, 1829 bp, Homo sapiens
  misc_feature (1388)..(1388): n is a, c, g, or t
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaaaaaaaaacaaaacgggcggccagctcgcgatctagaccagataccaatgatggcgcgatgtaacacgagaaagcacataccaggggcaccaaacaacaccgtggtccaaaaagggcttcgaaacgggataatcctatttattaccctcagaagcttcttaccttcgcgaggaatatacctgagccttttaccaactcagactaggccctaacccacaattaggagngcacactgggccccaaaaggaataacccgcataatccgctagaaattccaattctaaaaaatccgaataactcgattcagaggtatcatcaactgagttcaccaagacacatagaacacaactcggaaaccaaataataacaagcatgggtatttaaagagtaacgggggtataatatgtagaccagtaaaaagactgaaagatagttgagaggtcacattcaaaagtttacgaagaggtataagaggcaacaattatagtgtgccaaggcttcaaaggacatagattatgggcgaaataaaaaataggtatcgaccgaagagattatttttataacataagtggttaaacgcggaatgaatagaaaaagaggaaagatgtgccaatgagtgcgaaaaaaggggacgcaaaaaaaaaagcaaaaagaggaccaagtaaaga

SEQ ID NO: 354066 - DNA, 856 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttttgggaaggtctttagttccgaagatggtgtggtcattttccatttgggaaaaatttggaatgaaacttttgaaaaaaaaaaaatttaacccaaattttcaacttggaccttggtggccttttggccacagtgggaaaataaaccagtaaggtcccaatgtaaaaaaaggc

SEQ ID NO: 354067 - DNA, 270 bp, Homo sapiens
tgactccagtggctccaggttcagagcccctgctttagaatgaaacgacagggttattcagatagctattggctttgtaaggtttcatttttaaaaatcctaacctcctgatacttttcagtgcttcttttctcctacaggtgttaataatgcagtttatggaatagatgctatgaacccatcttcaagagatgactttacagagtttggaaagttactaaaagataaaattacacaatatgaaaagtcactatattatgccagtttttt

SEQ ID NO: 354068 - DNA, 517 bp, Homo sapiens
cagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaa

SEQ ID NO: 354069 - DNA, 2550 bp, Homo sapiens
  misc_feature (30)..(30): n is a, c, g, or t
  misc_feature (32)..(32): n is a, c, g, or t
  misc_feature (47)..(47): n is a, c, g, or t
  misc_feature (51)..(51): n is a, c, g, or t
ggtggaagagagagagagggagattaggcnangtacgaggctggtgntgantcggccgaggctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354070 - DNA, 1912 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggaaaaaaaatacccttgtaaatttaactgttagtccaaagaggaacagataaaacta

SEQ ID NO: 354071 - DNA, 1877 bp, Homo sapiens
  misc_feature (30)..(30): n is a, c, g, or t
  misc_feature (32)..(32): n is a, c, g, or t
  misc_feature (47)..(47): n is a, c, g, or t
  misc_feature (51)..(51): n is a, c, g, or t
ggtggaagagagagagagggagattaggcnangtacgaggctggtgntgantcggccgagggtgctttgcagtgataaacagaagcagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttgtcaccatagagcaacaaaggtatagggctgccttcctcttatttatttggggacattattttgttatttagataccaaggcctaattaattaagtacctataagaactatttatttggagtaactgagcctgtaactcaggtttatggctgttaagtatagattggggaatctttattatgtcttctcctaagcagtttaaccaaatgtgtggttagtgtttttttattcccctaagacagaaagaacaaaaaatgttttaaatttctcttatataggaaataataggaacgtcaaagctctgtatacctactaagtggaaaacaagaccatcatctaagtgatttgagaaattaacaaaagtagtgactacacagcaataattacagtaaattaaataaagattcctttaaggcagacaagggctaagatttccttagcagtaataatgacatacactgaattgaaaatctattttattacagaaagatcagtttctaacaaatgaaaatgtatcacctgttccttaactgtgtaaataataattaaatttctttgaaactgg

SEQ ID NO: 354072 - DNA, 1452 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcattggaaattgatgacttgaaaaaaattaccaattcactgactgtgctttgcagtgaaaaacagaagcaagaaaagcaaagcaaagccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggaacaccgtaatagctagaggaacaccgtaatagctagaggaacaccgtaatagctag

SEQ ID NO: 354073 - DNA, 818 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagatgctatgaacccatcttcaagagatgactttacagagtttggaaagttactaaaagataaaattacacaatatgaaaagtcactatattatgccagttttttggaagtcttagttcgagatgtgtgtatttcatgtaagtaattctaatttctagcccctctgggtagatttttagtaggatgttctcttcaggaggttgaaggttattttttattttcaaggatactataatac

SEQ ID NO: 354074 - DNA, 808 bp, Homo sapiens
gggggcgtggcctcggctcggcgcacagtcagccacggtcccatcctgctccgcgccggtcaacgagagcaaacccagtgactcacctccgccgtgctaactcctcgctagctctccctctcacacacgctcacacccggctcgagatggcggcggcggcggcggcggcgggggactcggactcctgggacgccgacgctttctccgtggaagacccagtgcggaaggtggggggcggcggcactgccggcggggaccgctgggaaggcgaggacgaggacgaggacgtcaaggataactgggatgacgatgatgatgaaaaaaaagaggaagcagaagtaaaaccagaggtaaaaatttcagaaaagaaaaaaatagcagagaagataaaagagaaagaacggcaacagaagaaaaggcaagaagaaattaaaaagaggttagaagaacccgaagaacctaaagtgctaacaccagaagaacaattagcagataaactgcggctaaagaaattacaggaagagtcagacctcgaattagcaaaggaaacttttggtgttaataatgcagtttatggaatagtttatgctgtacagcataaactattcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaat

SEQ ID NO: 354075 - DNA, 302 bp, Homo sapiens
tagattttgtagatcaggaatgtgggtgcaattggcacctatgattcagggtctctcacaaggctgcagtcatctcaaagcgctacttggggaggctgtttccaagctcactcatgcggcaattggcaggcctgaggtccttgttggctgcttgctggagagatatggtgtaagatacttcttcaagattggacagctggggaccttcttctgattaaccttaaaccaacttgtagccatagagacacctcacaaggcgtgtaactgacatcacgagatctggaacctcctaatattgcagt

SEQ ID NO: 354076 - DNA, 7148 bp, Homo sapiens
agatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttagggtagtttgaagtttgagtatcctcacgacatggcagctggattcctgagagagagtgatctgagagagtgacgaagacagaagccccagtgtcttttaagaatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354077 - DNA, 6227 bp, Homo sapiens
gctgtctagaggatcctgaaagaggggacagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354078 - DNA, 5579 bp, Homo sapiens
tcgagctcggcaccctgattgcatttagaagacacaataaatgaaaactggacatttccctattggttgaataagtttagtggttttttttggctcagggttggggagatccaaggttatgtcatgcaaaaagatgaatatgacctatcacacagttcgtgctgcatttagtttcatattttgtgactcagatctgtgaaagatacagataagaggtgtttgttttatttcttttttccttaaagtgttttacttcttttctagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354079 - DNA, 5669 bp, Homo sapiens
caggagagcactgaatctctttctgcctcttttctacaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354080 - DNA, 3965 bp, Homo sapiens
agatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttagggtagtttgaagtttgagtatcctcacgacatggcagctggattcctgagagagagtgatctgagagagtgacgaagacagaagccccagtgtcttttaagaatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcaggtgagcctctcactcaaactttgaaaagagcctgtgaaaatccagttgctgtgtaggttgatgcagtgggggctaccttggggaatccagttgccgtgtagttgatgcagtgggggctaccttggggaatcccgttgctgtgtaggttcatgcagtgggagctaccttggggaattccatgtttagattcaagatttggggggtggggaggggtttccagatataatttttaaactgatttttaattgattttttactgttttatttttttaattcaccaattaaaaatgtatgtttctcatgtacaa

SEQ ID NO: 354081 - DNA, 3430 bp, Homo sapiens
agatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttagggtagtttgaagtttgagtatcctcacgacatggcagctggattcctgagagagagtgatctgagagagtgacgaagacagaagccccagtgtcttttaagaatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgatgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354082 - DNA, 2169 bp, Homo sapiens
agatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttagggtagtttgaagtttgagtatcctcacgacatggcagctggattcctgagagagagtgatctgagagagtgacgaagacagaagccccagtgtcttttaagaatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtagaaacaattctgggatttgtggggagttggtttcttggcaccttttcataagcgttacctgtgctgtttttgttatgtttagaattgggaaatatgagtaatgttatgattaattcttcagcagcgtgatcagtcactgtgctaaaatgtaaccatcttatttca

SEQ ID NO: 354083 - DNA, 400 bp, Homo sapiens
acaaagataagaagatagctgagttggaaaggtaagaaagtgaagctgattggggcttatgaggttaaagtatggttttaaaagtatgcttttggggacatactttttcagtgtatctaactctgaatttaggttctcgaattcttgctattactgtattagctgccttttttctaggtcagttgtacgttctttgttgaggtgtctgaaaggcaacatagaatgggaataaattgggaagctatgggctgtaacataattgattggcaaaaaagagagtattcattaatttaaaattaaagttttttttactggcaaatcaagagaggacaaatgtctactttttaatttctctatataatgatcaaatgatcctcaagcaaaggagttaatcttttat

SEQ ID NO: 354084 - DNA, 156 bp, Homo sapiens
aaaattatttattctagatgtgtgttccttcttttaggcttcacttttggatctgaaagagcatgcttcttctctggcatcctcaggactgaaaaaggactcacggcttaagacactagagattgctttggagcagaagaaggaggagtgtctgaa

SEQ ID NO: 354085 - DNA, 6894 bp, Homo sapiens
cggcggcggcggtagtggcggcggcggcggtgcccgggcggcagcggcagcagtagcggcagccctgaggacggtgagacggccgcggcggcggcgacagcgcggaagtcgcgcgggacccagagcttcccccctgtcgctagtgctgaggctttcgcctttcctacccagcttcttgctcacggcccgggctgggctgggcagggcaacgcgcccccgggcaggggcggagctgtagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354086 - DNA, 6766 bp, Homo sapiens
ctttatgccagtcaagacgtgtgtaaaaccggcggccaagtgatattgtaatcggactccttaagacagagtttcactcttgttgcccaggctggagtgcaatgagtgcagtcttggctcactgcaattcccacctctcaagttcaagcgattctcctgtctcagcctcccgagtagctcagattacaggcacacgccaccacgcccggctaacttttgtattttagtagagacagggtttcatcatattggtcagactggtcttgaactcctgacctcagctgatttgcccaccttggcctcccaaagtgctggaattacacaggtgtgagccaccacgcccggctgttttgatgaaattttttgaaagaatgtattcatattcctgtagatttcccatttcccacattccctcaaatttagtttccgtgttaatatcttctattaattttgaacagtgtctttattgtagtttatgcaaagtgaggagtgagtgccatacttattttgcttcctgttgagaataaactgaagttaaattactgacattttgcatattatctcaatcattttttaaggacctgtaaaacagaataaggtgaatcctaatttgctagatgcagatttcttgtagctatttttgattcctgcaggctgctctgatttgctacttgaggaggaaagctgatttgggggttttctttttgtcttggttctagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccaggatgaggaggagggtatatgggcatagccaatcagaggcttagttcagccattttgttcagaacgatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354087 - DNA, 7083 bp, Homo sapiens
agatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttagggtagtttgaagtttgagtatcctcacgacatggcagctggattcctgagagagagtgatctgagagagtgacgaagacagaagccccagtgtcttttaagaatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354088 - DNA, 4830 bp, Homo sapiens
gagcacggtatggtggtacaagcgatgtcgggaatactgaggaaagaaggactgcatgtgaggttagagatgaccaggaagaacgtggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagacgcaaaatcgaatgaagctaatggccgacaactacgaggatgaccacttcaaatcctcccattccaatcaaacaaatcacaagccctccccagaccagatcatccagcccctcttagaacttgaccaaaatagaagtaaattaaagttgtacattggacacctgacaaccctctgccatgaccgagaccccctgatcctccgtggactcactccaccagcttcctataacttggacgatgaccaggcggcttgggagaatgagctgcagaagatgacccgggggcagcttcaggatgagttagagaaaggtgaacgggacaatgcagaactgcaggagtttgccaacgccattcttcagcagatagcagaccattgtcccgacatcctagagcaagtggtcaacgccctggaagagtcctcttgaccctgctttatggggaagcctgaggtagtcaacccaggagccaagaaaagagaactacgaggaacaggtgcccggaaccttcttggcaccaaacactacaaacttcatcccaacttgctcacttgaagaagtgtgattccagcaccgtttctacatctgccatcttactctgcctttctgctttggatgtggtctctacactaaccttcttgatgtccagggtagataaagggtcgaatctctctgaagaactgccacctggtcatcagcagtggagaactgtgggagctggtggctctgccctgacagagagccatggagcagaggagcctctcacctcctgtcctctgacatgagaatgaaaccaggaatggacttggagttcaacaggctgagaggatgcctccaatggaccagagagctgagtgttctaatatcacaataggtgctttctcctaaaagggcaaaaaacaatctcaaaaagattagaaaaagagaaggggggaagggaagagaaaatcgactcttctttttactgtctcttctgcttactttccacatgagatgctttgtaccggggagctgtgagcaggcctcacgatggcttgggagcactcgttctcccaaggtctgagtcttcatccagccctgcctgtctgtcgcagccttcctcactctgttcctcggccagttaacaagaagatggtgtgaggtgttctccaccagtctctcctgtttgagactgttgacgttatcatactgaggtgttagatcaaatatctctaattgaagaacatgtgaggttgaaagagcaccagccagggcaacatagcgtgaccctgtctctacaaaaaattaaaaagagaacatacaaagttgacatatgagaccctgttgtccccgcctgcagctttgccccagtaacagatgcccgttgctcttgggctggtttcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttcttctagcataaatgaaggtttttcctcctacacacattccttcctcggttatttcattcagagaatatttatgaaatgcctactgtgtgcaagtcatccatccttgaaaaggccacttctcagtgagggagagatgtagtggattctgtgagacatacctgctggagttgaagcagtaaatagcatgtccttcccctccccgatcttaaggtgtgttttctagaaaagttccctaatggaattcatgagtttgggggtctcagtcacccgcttgcctgtaggattccatttgatgattctggatttttgctgtttgttattgcccttagaggggctctgagtatctacttgtgggtggccatttcctgacatctgcatgtacctcgtggaattcagccagcttcatgttgcaaatcagaaagctgaccccaagactgcaaatcaatgaaggtattggcattgttaaggacgtagcgtagacaacagcagtcataaataattaggcaggaacttaacccaaatctagttctttgaccacctctaccaccagaacccagcagacactcacatctcctgataagagttgctggactcgatgtttttgttttgcattttctcctctccttccccacttactcagagaatttaaagtctgtagagtcagcacagccccatcagtccaggaacttcccaccaccagcccttgactgtcccattaactgacatggtcagatttccagctccccctactccctgctgtgaaacaatccctctccctgtgagaggaaactgtggagcgtttcttatcgaaggttaaatggactctgctcataaacctcttactgagatgcttcctgatagccaggctggccagagaggggtgcaggggttagatagtaagtggtggtcgtttgtggtcagttacctcaattctgttcattgcagtgcccgtaaaccatgtagaaagctcccagcactgaaaggcaggagtgttagcatctcgctttatccaccataacgtaaagaactgcggtgtgataacagccttcacggggccacggtggaaccaagacagcaggcgaggccatgcctaaacaagtggtctggcacgggcactggccagctgctctctccaagcaggtggcccagatcccacccacgtggactttctcatcaggtgcagcgcctgccactctcagccactgggtgtgtgactctcctcttcatctcagcattctccatcacttcccctccagaaaaacggatggaaggaagccctctgtgacactgcttctgagaagaagcatttccgggaccgatatcatctgtctggtctctgtgaacagcaaggaatcttcttgaccgttcttgggcactggaggctggctaggagttcagtaataaacgtggccttcgtgctgtagggcagagtggatgcagtttgtagctttcagagtgtctcattgagtctagatcattgaaccaacacttaaccaaatgtcccactcccatcacactaggacttgtcattccatgcccctctcctagtggtcatggtttcatatgggcatacaactgctactgaagttatatagccttgaaaactcagtgcaggttgcccttaattttccccaaacccctccatcggcaagtctagttgccctttagcacctaaagatctgcaccccaaaccaatgtcaccataaagagggcacgaagaagagtgggtgtgatcccaacggggttttgtaactgaagaagcccagtgtgagcttctcatcttttcatatacctctaacccccggtactcattgaatcattgatgaggtatctcaattgagatttgcaaggactttgataccatttgaaatggaaaaattttgaacgggctttaacatgtttaagaaatatggatggggccggccacagtggctcacgcctgtaatcccagaactctggaaggctgaggcaggcggatcacctgagatcaggagttcgaggccagcctggccaagatggcaaaaaccccgactctactaaaaatacaaaattagccaggcgtggtggcgtacgcctgtaatcccagctactcgggaggcaggagaatcgcttgagcctgggaggcagaggctgcggtgagccaagatcgtgtcactgcactccagcctgggtgac

SEQ ID NO: 354089 - DNA, 3504 bp, Homo sapiens
agatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttagggtagtttgaagtttgagtatcctcacgacatggcagctggattcctgagagagagtgatctgagagagtgacgaagacagaagccccagtgtcttttaagaatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggagccattctaaatttatgaaaaataaggtagaacaactgaaggaggaactaagttcgaaagaggctcaatgggaggagctgaaaaagaaagcggctggtcttcaggctgagattggccaggtgaaacaggagctgtccagaaaggacacagaactactcgccctgcagacaaagctagaaacactcacaaaccagttctcagatagtaaacagcacattgaagtgttgaaggagtccttgactgctaaggagcagagggctgccatcctgcagactgaggtggatgctctccgattgcgtttggaagagaaggaaaccatgttgaataaaaagacaaaacaaattcaggatatggctgaagagaaggggacacaagctggagagatacatgacctcaaggacatgttggatgtgaaggagcggaaggttaatgttcttcagaagaagattgaaaatcttcaagagcagcttagagacaaggaaaagcagatgagcagcttgaaagaacgggtcaaatccttgcaggctgacaccaccaacactgacactgccttgacaactttggaggaggcccttgcagagaaagagcggacaattgaacgcttaaaggagcagagggacagagatgagcgagagaagcaagaggaaattgataactacaaaaaagatcttaaagacttgaaggaaaaagtcagcctgttgcaaggcgacctttcagagaaagaggcttcacttttggatctgaaagagcatgcttcttctctggcatcctcaggactgaaaaaggactcacggcttaagacactagagattgctttggagcagaagaaggaggagtgtctgaaaatggaatcacaattgaaaaaggcacatgaggcagcattggaagccagagccagtccagagatgagtgaccgaatacagcacttggagagagagatcaccaggtacaaagatgaatctagcaaggcccaggcagaagttgatcgactcttagaaatcttgaaggaggtggaaaatgagaagaatgacaaagataagaagatagctgagttggaaagtctcacctcaaggcaagtgaaagaccagaataagaaggtagcaaatctgaagcacaaggaacaggtggaaaaaaagaagagtgcacaaatgttagaggaggcgcgacgacgggaggacaatctcaacgacagctctcagcagctacaggacagtctccgtaagaaggatgacaggattgaagagctggaagaagcactaagagaaagtgtacagataactgcagagcgggaaatggtgctagcacaagaggaatcagccaggaccaatgctgaaaaacaggtggaggagttactgatggccatggagaaggtaaagcaggaactagaatccatgaaagcaaagctgtcctccacccagcagtctctggcagaaaaggaaactcacttgactaatcttcgggcagagagaaggaaacacttagaggaagttctggagatgaagcaagaagctcttctggctgccattagtgaaaaagacgccaatatagctctcttggagctttcgtcctctaagaagaagacccaagaggaagtggctgccctgaagcgggagaaggatcgtctggtacagcagcttaagcagcagtgatactttcttcatttttcatcccttcatctcaagtcagcgtcagttttattgctttaaaagtcaacagtgatactatccagttctgctaagagtgaaactttaagaataaaatttgattttaattcatccctt

SEQ ID NO: 354090 - DNA, 1748 bp, Homo sapiens
agatgtggggatcctggggcgggaggtgggggagtggggactggggctctgggcacttggggagcggagggggggaggcttaggactagtgaagccgcggacgaggtagtggggagacggagaaattggggagccatgaggttggggtgcggtcagggtggatctttgggttagggtagtttgaagtttgagtatcctcacgacatggcagctggattcctgagagagagtgatctgagagagtgacgaagacagaagccccagtgtcttttaagaatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccagcacatgcagatgacaatccaggctctccaggatgaattgcggatccagagggacctgaatcagctgtttcagcaggatagtagcagcaggactggcgaaccttgtgtagcagagctgacagaggagaactttcagaggcttcatgctgagcatgagcggcaggccaaagagctgtttcttcttcgaaagacattggaggaaatggagctgcgtattgagactcaaaagcagaccctaaatgctcgggatgaatccattaagaagcttctggaaatgttgcagagcaaaggactttctgccaaggctaccgaggaagaccatgagagaacaagacgactggcagaggcagagatgcacgttcatcacctagaaagccttttggagcagaaggaaaaagagaacagtatgttgagagaggagatgcatcgaaggtttgagaatgctcctgattctgccaaaacaaaagctctgcaaactgttattgagatgaaggattcaaaaatttcctctatggagcgtgggcttcgagacctggaagaggaaattcagatgctgaaatcgaatggtgctttgagtactgaggaaagggaagaagaaatgaagcaaatggaagtgtatcggaagggcacatcggggatcctctggcg

SEQ ID NO: 354091 - DNA, 611 bp, Homo sapiens
agtttatctagtgcctagaacaatagctggcttaaagaggtcaaatggtattatcattatgaccctggaaatgaaggcttggattgtatttaagttggatccattccagtgatgacagctgtgctaacgtcacctctggtggctttgtccccaagattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaa

SEQ ID NO: 354092 - DNA, 615 bp, Homo sapiens
acccaacacaaggcctctctcagcaacactcaagaaattatcactaggatgaaatcctaaagattttaatctagagagggagaaatggaaggagaaaggaatggatgggaaaggttaagaaagaagaactagggtcgtgggtttgagtgacaggggaaaaagtgattttatcactaagtgaggtccagaagaaaaactgactgggggagggagctaatttttctttttgacttcttgggtttgagatccagtgtgatgtctgggtacagacattcactaggaagtgggaaggccagtatctacaaaagaaaaacctccagaataacctcattcattgactccttctgtctttcagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagcaaaaaaaaaaa

SEQ ID NO: 354093 - DNA, 446 bp, Homo sapiens
ccactgcaccacagcctgggtgacggggaaagaccctgactcaaaaacaaaaacacaaaaaaaagtatgagtgatttgatggctgtaatccttcatccttcaatgtgtttgtttgcttttttctctttcaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaa

SEQ ID NO: 354094 - DNA, 2498 bp, Homo sapiens
gaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaa

SEQ ID NO: 354095 - DNA, 2043 bp, Homo sapiens
gaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaaggtattataatgacgggacagataggtgacaggtttaaatccttgaaggagaagtggagctttaagagcagaaatgtgaagagctcccgttaggattcaacagcatgatttataaggagttaaatgttcatagaaaaaaaactgtgggtgacaaagttaggagcacatattgttcctgatggtggagaactttaaatgcaagtaaaggagtacaggaactttaaatg

SEQ ID NO: 354096 - DNA, 1904 bp, Homo sapiens
aattccggcatcgctttgctgggaggatgttccaggctcactgactcttggcgcacagggtgaacagcttggttgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgaaatgtgagttcctcctcttgaaggcctactgtcatccacaaagctccttttttacgggcatcccatttaatattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaa

SEQ ID NO: 354097 - DNA, 701 bp, Homo sapiens
cacgttatctgcccttgcagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaa

SEQ ID NO: 354098 - DNA, 2077 bp, Homo sapiens
gaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagcaaaaaaaaaaa

SEQ ID NO: 354099 - DNA, 2570 bp, Homo sapiens
gaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgaaatgtgagttcctcctcttgaaggcctactgtcatccacaaagctccttttttacgggcatcccatttaatattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaa

SEQ ID NO: 354100 - DNA, 1927 bp, Homo sapiens
gaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagcaaaaaaaaaaa

SEQ ID NO: 354101 - DNA, 1443 bp, Homo sapiens
gaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggtaaaacttggagattgctggtctcagagtacagtcaccaggaatctaaattcagagctgtcttacactgaggcaatatttcttaac

SEQ ID NO: 354102 - DNA, 2195 bp, Homo sapiens
gaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccagagtccagcctgttattgtgaatggagccgagatttgccctctaccctcacctaagctctgatccttcagtgcccgcaataggcggctcatctgttatccattgtgtaaatgactagaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagcaaaaaaaaaaa

SEQ ID NO: 354103 - DNA, 1929 bp, Homo sapiens
gaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaacggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagcaaaaaaaaaaa

SEQ ID NO: 354104 - DNA, 947 bp, Homo sapiens
atggcgagcagcggagtcaagaacacaccacgatggcggagaaaagcccctcatgggagggaaaggaaagagaaaggaaagaaaagaaaaagatgtatctggtcaactccaaaaaggagacataagaaaaaaagcctcccaagagagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagcaaaaaaaaaaa

SEQ ID NO: 354105 - DNA, 605 bp, Homo sapiens
ggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagagggtaaggctgatgatggaatctgccatttgaatggctcagtgtgggagggtctctcctgaagcaggtacagagttaagtagatatgtaaagtcaatagtaaaaggaaaaagtacagagaatgaggatggggtataacaagaggaacaaagagagcaagcatctgttgcatctgaaaagttttgtggaagaaacagacgtgttcacagggacagctgtggcctggggcagcagctctcaaattttttggtctcaggactcctttatgctctcaaaaattattgaggaccctaaggagcttctgtttatgttgtttatgtctatctacatgtacctgattagaaattaaaactaataattttaaaatattaattcatgtaaaagtaacaataataaaccaattgcctgttaacataaatagcattattttatgaaaagtaaatatattttctaaaaca

SEQ ID NO: 354106 - DNA, 2677 bp, Homo sapiens
ggtcgattccatttggcccggggatggtcacacgcgcgggggccggaactgccgtcgccggcgcggtcgttgtcgcattgctctcggccgcactcgcgctgtacgggccgccactggacgcagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354107 - DNA, 1759 bp, Homo sapiens
ggtattttattgcatttcattctcttttatcaaaatgactggaaagtgcagaaagccccgaagctgatgctggtagtggaatctcaggcactgagtgtggcgagtctcaactggccactcccacggagcctggggaggcttcagcaagagccaagtgagagcagggcagaggccgggcccagcgccagcgaggcatctggggagccgtgcccttgttagcgctgaaaatggaagcccctccattcaggcctggacagatgatgggcagcgaatgtgctcacctgctgagctgtggggctggactaggtaccaaaatcagggtagaacactgaggcgtctgtgggcgggtgtgtgcacatccacacttgtacactcacattcacatgcacatatgtgcacacgcatgcaattcatacacatgcacagttgtgctcacagcctcgcacgcccttgcacactcgcacttatacacatgcatggtcatgctcacagcctcgcacacgccctcgcacactcatccacacacagctgtgcacaaggaacacagagcagatgttctcagagggactctgacacctttgagatgagggttttttaatcactggaaggctctcttgggtctaacaggttcagagaatgtaacacctggttttcaaaacatttttcaaagaaatagagaattcccatacacaggcatacgtgacgttatgaggccggtggaggcctcgctcggtgttgccctgtatggttgagctgtggtttaaggtgaactctggagtgtgggctgcaggtgagggctccgtccctgggagctggtgggaggagctggaggctggcgccgccctgctcagagctgcctgcttgggctcgtctgaggcggttccgagctgcaggtgtctccaccaacctgctgtgctacacagcggggtctggggcagcctcaccactgcgtgtcttggtttcctcttctgtaaaacagaggctgcctccaacccttggaacaaacagggaagagccgtagcaggcaggatgtgagtggagcctcaggctgctcctggagggtgtggctctgcctgccgtgcggccttccacacccgtggctactgtcacattcacacacatggccatgctgacacctgctctcacttctgccctgtgcagtgcttgtgtgcagccaggaaggcagcagccgcaggtgtggagggcaaggggacctcctgtcgggctccctgggcgtcctggtacactgggcgctccttgctggaccacagaaaacaaatgggggtaaggccacgtcttcatttattctactttgaaaccgtctgatttttctaagctgtttcagtagctcatgcgttgaataagtagccctggaaacactgacaatgaactctaggcttcactggagagatctcggcacagacgaaccctcttggcagaagcttccaccccacacttgggcctgggcctgtccatcattcactgtggatggggcctggggcaggggtggtcttcagagctctccagagagttccgaggtgcaaccaaggcccagcagcacgctgttctgggaagttgagtggtttattctgtgtaacacagaatactaagatagaaaacagacagggtcaaggcttacttagacacttgttcttaaagatgtgaattttctttaagagacagcagaattctaggaccagggcccttggcccagttctgtagtcagagaactttatgaatgcaagcagttcccatacct

SEQ ID NO: 354108 - DNA, 2299 bp, Homo sapiens
ataaacttgcgcccgcacctgtgattaaggcctacagcccggagctgatcgtccacccagttcttgacagccccaatgctgttcatgaggtggagaagtggctgccccggctgcatgctcttgtcgtaggacctggcttgggtagagatgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354109 - DNA, 2471 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggattgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354110 - DNA, 2375 bp, Homo sapiens
cttccaatggctggtttccggcgacggcgcgggggcagctgggaatccggaatgctgcccgatggccctgggtcctcgctgtggggcaatccgggcttgcagacgagtgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354111 - DNA, 2512 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgtgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354112 - DNA, 2327 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354113 - DNA, 2471 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaaggctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354114 - DNA, 2907 bp, Homo sapiens
ggtattttattgcatttcattctcttttatcaaaatgactggaaagtgcagaaagccccgaagctgatgctggtagtggaatctcaggcactgagtgtggcgagtctcaactggccactcccacggagcctggggaggcttcagcaagagccaagtgagagcagggcagaggccgggcccagcgccagcgaggcatctggggagccgtgcccttgttagcgctgaaaatggaagcccctccattcaggcctggacagatgatgggcagcgaatgtgctcacctgctgagctgtggggctggactaggtaccaaaatcagggtagaacactgaggcgtctgtgggcgggtgtgtgcacatccacacttgtacactcacattcacatgcacatatgtgcacacgcatgcaattcatacacatgcacagttgtgctcacagcctcgcacgcccttgcacactcgcacttatacacatgcatggtcatgctcacagcctcgcacacgccctcgcacactcatccacacacagctgtgcacaaggaacacagagcagatgttctcagagggactctgacacctttgagatgagggttttttaatcactggaaggctctcttgggtctaacaggttcagagaatgtaacacctggttttcaaaacatttttcaaagaaatagagaattcccatacacaggcatacgtgacgttatgaggccggtggaggcctcgctcggtgttgccctgtatggttgagctgtggtttaaggtgaactctggagtgtgggctgcaggtgagggctccgtccctgggagctggtgggaggagctggaggctggcgccgccctgctcagagctgcctgcttgggctcgtctgaggcggttccgagctgcaggtgtctccaccaacctgctgtgctacacagcggggtctggggcagcctcaccactgcgtgtcttggtttcctcttctgtaaaacagaggctgcctccaacccttggaacaaacagggaagagccgtagcaggcaggatgtgagtggagcctcaggctgctcctggagggtgtggctctgcctgccgtgcggccttccacacccgtggctactgtcacattcacacacatggccatgctgacacctgctctcacttctgccctgtgcagtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354115 - DNA, 1786 bp, Homo sapiens
tgtgataaacctgctttctcctcaggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354116 - DNA, 1495 bp, Homo sapiens
ttaggcacgcgtgcctaataggcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354117 - DNA, 799 bp, Homo sapiens
  misc_feature (10)..(10): n is a, c, g, or t
  misc_feature (13)..(13): n is a, c, g, or t
  misc_feature (23)..(23): n is a, c, g, or t
tttgtttccnttncactctagangatccccgagtgggtaagtgtcttacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354118 - DNA, 1377 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggggtaaggccacgtcttcatttattctactttgaaaccgtctgatttttctaagctgtttcagtagctcatgcgttgaataagtagccctggaaacactgacaatgaactctaggcttcactggagagatctcggcacagacgaaccctcttggcagaagcttccaccccacacttgggcctgggcctgtccatcattcactgtggatggggcctggggcaggggtggtcttcagagctctccagagagttccgaggtgcaaccaaggcccagcagcacgctgttctgggaagttgagtggtttattctgtgtaacacagaatactaagatagaaaacagacagggtcaaggcttacttagacacttgttcttaaagatgtgaattttctttaagagacagcagaattctaggaccagggcccttggcccagttctgtagtcagagaactttatgaatgcaagcagttcccatacct

SEQ ID NO: 354119 - DNA, 536 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgtgacagccccaatgctgttcatgaggtggagaagtggctgccccggctgcatgctcttgtcgtaggacctggcttgggtagagatgatgcgcttctcagaaatgtccaggtaatgtgtatactcactcacttccctcatgacaggcttagccttaggcgtgaagttggaacagaggcatttctcttgcattttgtgtagtgttccgtgtgcctctttgtggcatgattgaga

SEQ ID NO: 354120 - DNA, 2436 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgtgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354121 - DNA, 2525 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354122 - DNA, 2249 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354123 - DNA, 2315 bp, Homo sapiens
cttccaatggctggtttccggcgacggcgcgggggcagctgggaatccggaatgctgcccgatggccctgggtcctcgctgtggggcaatccgggcttgcagacgagtgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354124 - DNA, 2357 bp, Homo sapiens
  misc_feature (28)..(28): n is a, c, g, or t
  misc_feature (31)..(31): n is a, c, g, or t
gccaggtagcgaggccccttggggtgtnggnctcgctgtggggcaccgggctgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354125 - DNA, 2398 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgtgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagcgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354126 - DNA, 2031 bp, Homo sapiens
ctggagcaggcaccgtgtcagcacctgctcggaggactcactgcaggtgatatcctgggcatcctcccacctacatggcctttaacaggtgcctgggtgatccctttagacacgagagcatgagtctcatggcggatgggacagggctatctgtcgtcgtgtgtctgaggaagactttgctttttctctgtcttcctgtgttgtcatagctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatggcaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354127 - DNA, 1207 bp, Homo sapiens
taagtgctagtacgaggccggtgtttgaatcggccgagggctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaatttaaaaaaaaa

SEQ ID NO: 354128 - DNA, 2049 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggatggcctgtggctggtcgctcagcagccggccctcatccatggctaccggaaggctgtgctcactcccaaccacgtggagttcagcagactgtatgacgctgtgctcagaggccctatggacagcgatgacagccatggatctgtgctaagactcagccaagccctgggcaacgtgacggtggtccagaaaggagagcgcgacatcctctccaacggccagcaggtgcttgtgtgcagccaggaaggcagcagccgcaggtgtggagggcaaggggacctcctgtcgggctccctgggcgtcctggtacactgggcgctccttgctggaccacagaaaacaaatgggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggacttccagataaacattgtcctataattgagcttcagactcatgctctgtcttccggccgg

SEQ ID NO: 354129 - DNA, 1171 bp, Homo sapiens
cttccaatggctggtttccggcgacggcgcgggggcagctgggaatccggaatgctgcccgatggccctgggtcctcgctgtggggcaatccgggcttgcagacgagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtacactggagccccatattttgcagcaatctcagctctcaaagtgggcgcagacttgtcccacgtgttctgtgccagtgcggccgcacctgtgattaaggcctacagcccggagctgatcgtccacccagttcttgacagccccaatgctgttcatgaggtggagaagtggctgccccggctgcatgctcttgtcgtaggacctggcttgggtagagatgatgcgcttctcagaaatgtccagggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtggtgagtcagtggaccccctggagggtagatgcaagccctgttcgtcctgaagagggtgaaggacgagctccatgcttctgcccagcctgtccctgtggacacacctgcaagtaatcgctgtgcctctcccagcggatggcgcgtcttcccattaatgcgcttggattggatgaacgatggtgtagtgggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatggtaagtgtcccatcaatgttagtgcccagtacgactggaatttgtattactcctgcaaagctctcagaacccagtctt

SEQ ID NO: 354130 - DNA, 483 bp, Homo sapiens
  misc_feature (404)..(404): n is a, c, g, or t
  misc_feature (415)..(415): n is a, c, g, or t
  misc_feature (441)..(441): n is a, c, g, or t
  misc_feature (474)..(474): n is a, c, g, or t
ttccttctggccttctgggagctggtggggagatcactgtctgtgtgcagggctcagagctgctttctgatgacgaggtgcccctcgggatagggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaagacctgggntccatttggangacggccgttgattggcaaggaagantgccccttttaaaatttgaattgtaacccaatnttttttgga

SEQ ID NO: 354131 - DNA, 386 bp, Homo sapiens
cacctggcgggcgtgtatccacatcaatagtgctccctctgatctctggagaacagcactgggggcgcagatgtccccagtttttgctggtgatcaacaagtgaggccgctgctccattctacacaggacagcatttccaggggtttccagtattctgtctagattcataaaggtcaaaggccttgagaatctatgtgtgcctttctatcttaggtaaagaagagaaagagaaagcaaattctcgttactcctctttcaaaaagttcattaaaagccaggctggcagctcacagtgctataatcccagcactgtggaaggcctaggcaggaggattgagaggagttccagaccaacctgggcaacaccgtgagaccccatctctac

SEQ ID NO: 354132 - DNA, 3216 bp, Homo sapiens
tcggccccggctctggcgtccctggctgccaagctgaggcccgcagtcctactcccgccgagacccgccgctccggtcctgccccgaactgcccacggccggcagcgcttccaggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggccgtggtcctcgtggaagggctgcagcggaagcccaggaaacacaggcagcggggctcagagctgctttctgatgacgaggtgcccctcgggatagggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctacc

SEQ ID NO: 354133 - DNA, 5790 bp, Homo sapiens
  misc_feature (3292)..(3292): n is a, c, g, or t
  misc_feature (3573)..(3573): n is a, c, g, or t
  misc_feature (3578)..(3578): n is a, c, g, or t
  misc_feature (3580)..(3580): n is a, c, g, or t
  misc_feature (4338)..(4338): n is a, c, g, or t
  misc_feature (4354)..(4354): n is a, c, g, or t
  misc_feature (4379)..(4379): n is a, c, g, or t
  misc_feature (4444)..(4444): n is a, c, g, or t
tcggccccggctctggcgtccctggctgccaagctgaggcccgcagtcctactcccgccgagacccgccgctccggtcctgccccgaactgcccacggccggcagcgcttccaggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggccgtggtcctcgtggaagggctgcagcggaagcccaggaaacacaggcagcggggctcagagctgctttctgatgacgaggtgcccctcgggatagggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctaccaaaaaaaaaaaaaaaaaaaaaaagccaggtgcagtggctcacgcttgtaatcccagcactttgggaggccgaggcnggtggatcacaaggtcaggagatcgagaccatcctggccaacatggtgaaaccccatctctactaaaaacacaaaaattagctaggcatggtggcgtggcacgtgcctgtagtcccagctactcgggaagctgaggcaagagaatcacttgaaccagggaggcggaggttgcagtgagccgaggtcgcaccgttgtactccagcctggtgatagaacgagactccacaaaaaaaaaaaaaaattagccaggcatgatggggtgtgcctgtagtcccagctncttgngnggctgaggctggaggatcacttgagcccaggaagttgaggctgcagtgagctgtgattgtgccactgcactcatcctggaagacagagtgagatcctgtctcagataaaataaacaattttttttttaagtcattgcttctggcccctgtgtgctctgtcctgtgtctgcagaatggggctgcctggttgagggacggcttttaccttctagactagctctgggatctctcatggggcatgaggtacccagctagatgtggccaggccacactccaggagctagcaaagcacccagcgttgctgacacccatctccccagcgcagcctgagcccccaggcccctctctcatatccaggcctgtgctggaggtggcggcctctgggggagtgtggttggggtctgcccacttccctccccctgccgaggctgtggcctcccgctggctgctgcttggccccatctcatggtcgctgcctgctgcttggccccatctcatgggcgtcatcctcagcactcacgtgatgggagagttttgtaggagctgtgagtcccaggtgcctgcgtgtgctgtgatgttatctcatgcagtccagtgaggggggactcccattagtctcctttttttgttttgttttgagacacagtctcacttcattacccaggctggagtgcaaggcacgatcttggctcaccacaacctccacctcccaggttcaagtgattctcctgcctcagcctcctgagtagctgggattncaggtgcgcaccactncgcctggctaatttttgtatttttngtagagatggggtttctccatgttggtcaggctggtcttgaactcccgaccttgtgatccacccncctcggcctcccaaagtgctgggattacaggcgtgagccaccgcgcccggccatgattctccttctgtgggtggaggaactgggcactgggagcgtgaaaaccttgcccaggtggcagagccagctttggacgcaggtctgacttcctacctcactccccttgccttgacagacacagtaattcagagttgaacttggaacagagtttattttccatcactgtaaaacattctcagtgaggttactggcattaaaaaggtgggagaaatggaagaaaatggggttgaagaaaaaaaaagcctttgctcttgacagctaggcagccacagcggaggccgccaggctgcgagggcagcgtatgggggcagagcccggttctggcggcacaggccccggagtggagggggcaggggagggtctctgtaggtgggagagggcctgggggctgggaggcagcctggccttgtgccctacaggagggacctcctgggactttatggaagcctgtcttgcctttgacttgcaatgaaaatgcccctcatcattgggagtggggtcgggtgggggtccccagtggccagatcacgtggggtccagagagcagacatctgtagccctgatcttggcggccagtgaccacggccaagcagggcctgtcttttgcctggtacaaggcttgatgagaagagacccctgcccatcctcagtggcctggcagccaggggtgaaccccaggggaagctgggacactgtcccaaaggcccggcgccctactgtgctgcctgagcccgtggcaccgtggggcccaaggtggtgatgatttctctgctcttcccacggggcagacagcaggacacatcctggagacaaggttggggagacaaacaggtgcccaggtcagggctgatcacagcagttacaaaagcatcccgtgaagacggggctgcaagacggtgctggcaaaggaacaggacccaggaagaccaggcttgtcctgtggaggggccgggtcttggcagggggcaagcagatgtccccagtttttgctggtgatcaacaagtgaggccgctgctccattctacacaggacagcatttccaggggtttccagtattctgtctagattcataaaggtcaaaggccttgagaatctatgtgtgcctttctatcttaggtaaagaagagaaagagaaagcaaattctcgttactcctctttcaaaaagttcattaaaagccaggctggcagctcacagtgctataatcccagcactgtggaaggcctaggcaggaggattgagaggagttccagaccaacctgggcaacaccgtgagaccccatctctac

SEQ ID NO: 354134 - DNA, 2482 bp, Homo sapiens
agagacgagatctcactgcgttgcccaagctggtcttgaactcctgggctcaagcaatcctcccacttcagccttccaaagtgctgggattataggcgtgagccacagtgcccagcccctgctaaatgttttgtaggggaaccttaggagccctgtgaggccttcattttcctattagaaggatttcccttgccctcttgctgtgagttcctagagatcgtgctttctctgtctcaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctacc

SEQ ID NO: 354135 - DNA, 3657 bp, Homo sapiens
  misc_feature (2558)..(2558): n is a, c, g, or t
  misc_feature (2839)..(2839): n is a, c, g, or t
  misc_feature (2844)..(2844): n is a, c, g, or t
  misc_feature (2846)..(2846): n is a, c, g, or t
agagacgagatctcactgcgttgcccaagctggtcttgaactcctgggctcaagcaatcctcccacttcagccttccaaagtgctgggattataggcgtgagccacagtgcccagcccctgctaaatgttttgtaggggaaccttaggagccctgtgaggccttcattttcctattagaaggatttcccttgccctcttgctgtgagttcctagagatcgtgctttctctgtctcaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctaccaaaaaaaaaaaaaaaaaaaaaaagccaggtgcagtggctcacgcttgtaatcccagcactttgggaggccgaggcnggtggatcacaaggtcaggagatcgagaccatcctggccaacatggtgaaaccccatctctactaaaaacacaaaaattagctaggcatggtggcgtggcacgtgcctgtagtcccagctactcgggaagctgaggcaagagaatcacttgaaccagggaggcggaggttgcagtgagccgaggtcgcaccgttgtactccagcctggtgatagaacgagactccacaaaaaaaaaaaaaaattagccaggcatgatggggtgtgcctgtagtcccagctncttgngnggctgaggctggaggatcacttgagcccaggaagttgaggctgcagtgagctgtgattgtgccactgcactcatcctggaagacagagtgagatcctgtctcagataaaataaacaattttttttttaagtcattgcttctggcccctgtgtgctctgtcctgtgtctgcagaatggggctgcctggttgagggacggcttttaccttctagactagctctgggatctctcatggggcatgaggtacccagctagatgtggccaggccacactccaggagctagcaaagcacccagcgttgctgacacccatctccccagcgcagcctgagcccccaggcccctctctcatatccaggcctgtgctggaggtggcggcctctgggggagtgtggttggggtctgcccacttccctccccctgccgaggctgtggcctcccgctggctgctgcttggccccatctcatggtcgctgcctgctgcttggccccatctcatgggcgtcatcctcagcactcacgtgatgggagagttttgtaggagctgtgagtcccaggtgcctgcgtgtgctgtgatgttatctcatgcagtccagtgaggggggactcccattagtctcctttttttgttttgttttgagacacagtctcacttcattacccaggctggagtgcaaggcacgatcttggctcaccacaacctccacctcccaggttcaaggagaatcacttgagccggggaggcggaggttgcagtgagccgaggtcgcaccgttgtactccagcctggtgatagaacgagactccacaaa

SEQ ID NO: 354136 - DNA, 3659 bp, Homo sapiens
  misc_feature (2558)..(2558): n is a, c, g, or t
  misc_feature (2839)..(2839): n is a, c, g, or t
  misc_feature (2844)..(2844): n is a, c, g, or t
  misc_feature (2846)..(2846): n is a, c, g, or t
agagacgagatctcactgcgttgcccaagctggtcttgaactcctgggctcaagcaatcctcccacttcagccttccaaagtgctgggattataggcgtgagccacagtgcccagcccctgctaaatgttttgtaggggaaccttaggagccctgtgaggccttcattttcctattagaaggatttcccttgccctcttgctgtgagttcctagagatcgtgctttctctgtctcaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctaccaaaaaaaaaaaaaaaaaaaaaaagccaggtgcagtggctcacgcttgtaatcccagcactttgggaggccgaggcnggtggatcacaaggtcaggagatcgagaccatcctggccaacatggtgaaaccccatctctactaaaaacacaaaaattagctaggcatggtggcgtggcacgtgcctgtagtcccagctactcgggaagctgaggcaagagaatcacttgaaccagggaggcggaggttgcagtgagccgaggtcgcaccgttgtactccagcctggtgatagaacgagactccacaaaaaaaaaaaaaaattagccaggcatgatggggtgtgcctgtagtcccagctncttgngnggctgaggctggaggatcacttgagcccaggaagttgaggctgcagtgagctgtgattgtgccactgcactcatcctggaagacagagtgagatcctgtctcagataaaataaacaattttttttttaagtcattgcttctggcccctgtgtgctctgtcctgtgtctgcagaatggggctgcctggttgagggacggcttttaccttctagactagctctgggatctctcatggggcatgaggtacccagctagatgtggccaggccacactccaggagctagcaaagcacccagcgttgctgacacccatctccccagcgcagcctgagcccccaggcccctctctcatatccaggcctgtgctggaggtggcggcctctgggggagtgtggttggggtctgcccacttccctccccctgccgaggctgtggcctcccgctggctgctgcttggccccatctcatggtcgctgcctgctgcttggccccatctcatgggcgtcatcctcagcactcacgtgatgggagagttttgtaggagctgtgagtcccaggtgcctgcgtgtgctgtgatgttatctcatgcagtccagtgaggggggactcccattagtctcctttttttgttttgttttgagacacagtctcacttcattacccaggctggagtgcaaggcacgatcttggctcaccacaacctccacctcccaggttcaagagaatcgcttgaacccgggagttggaggttgcagtgaaccgagatcgcaccactgcactccagcctgggcgacagagcaagactccgcctcaa

SEQ ID NO: 354137 - DNA, 3217 bp, Homo sapiens
tcggctcactgcaacctgcgccttagcctcctgagtagctaggattacaggcatgaaccaccacgcccaggtttctccacgttagtcaggctggtctcgaactcccgacctcagggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtggagacggaggaccccagccctgagactttccgccagctcttccggctcttctgctaccaggaggtggctgggccccgggaggccctgagccgcctctgggagctgtgctgccgctggctgcggccggagctgcgcaccaaggagcagatcctggagctgctggtgctggagcagttcctgactgtgctgccgggggagatccaggctcgggtacgcgagcagcagccggagagcggtgaggaggccgtggtcctcgtggaagggctgcagcggaagcccaggaaacacaggcagcggggctcagagctgctttctgatgacgaggtgcccctcgggatagggggacagttcttaaaacaccaggcagaggctcagccagaggatctgtccctggaggaagaggctcgattctccagccagcagcccccagcccagctgagccacaggccacagaggggcccgctgttgtggccagagagaggccctccagctccccggcatcaggagatggcgtcagcctcgcccttcctttcggcctggtcccaggtgcccgtgaacttggaggacgtggctgtatacctttctggggaggagccaagatgcatggacccagctcagcgggacgcgccgctggagaatgaaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctacc

SEQ ID NO: 354138 - DNA, 2517 bp, Homo sapiens
gcggccgcatcagagacagcccgggccaggtcccatggacaccacctgcaccgtgattgaggaaccctgatctgaagatctctgagcgcacattacctgtggtctagttcattccctgtgcaaaaggcagaagtcaaaagggaaagaatttgccagccctcccggctcccaagtggttacgtggaatcctcagaagggaaggaatgagattctgcccagctctgtccaccagctcctggagcccagacacagcttccctctcagggtcacaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctacc

SEQ ID NO: 354139 - DNA, 5014 bp, Homo sapiens
  misc_feature (2558)..(2558): n is a, c, g, or t
  misc_feature (2839)..(2839): n is a, c, g, or t
  misc_feature (2844)..(2844): n is a, c, g, or t
  misc_feature (2846)..(2846): n is a, c, g, or t
  misc_feature (3604)..(3604): n is a, c, g, or t
  misc_feature (3620)..(3620): n is a, c, g, or t
  misc_feature (3645)..(3645): n is a, c, g, or t
  misc_feature (3710)..(3710): n is a, c, g, or t
agagacgagatctcactgcgttgcccaagctggtcttgaactcctgggctcaagcaatcctcccacttcagccttccaaagtgctgggattataggcgtgagccacagtgcccagcccctgctaaatgttttgtaggggaaccttaggagccctgtgaggccttcattttcctattagaaggatttcccttgccctcttgctgtgagttcctagagatcgtgctttctctgtctcaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctaccaaaaaaaaaaaaaaaaaaaaaaagccaggtgcagtggctcacgcttgtaatcccagcactttgggaggccgaggcnggtggatcacaaggtcaggagatcgagaccatcctggccaacatggtgaaaccccatctctactaaaaacacaaaaattagctaggcatggtggcgtggcacgtgcctgtagtcccagctactcgggaagctgaggcaagagaatcacttgaaccagggaggcggaggttgcagtgagccgaggtcgcaccgttgtactccagcctggtgatagaacgagactccacaaaaaaaaaaaaaaattagccaggcatgatggggtgtgcctgtagtcccagctncttgngnggctgaggctggaggatcacttgagcccaggaagttgaggctgcagtgagctgtgattgtgccactgcactcatcctggaagacagagtgagatcctgtctcagataaaataaacaattttttttttaagtcattgcttctggcccctgtgtgctctgtcctgtgtctgcagaatggggctgcctggttgagggacggcttttaccttctagactagctctgggatctctcatggggcatgaggtacccagctagatgtggccaggccacactccaggagctagcaaagcacccagcgttgctgacacccatctccccagcgcagcctgagcccccaggcccctctctcatatccaggcctgtgctggaggtggcggcctctgggggagtgtggttggggtctgcccacttccctccccctgccgaggctgtggcctcccgctggctgctgcttggccccatctcatggtcgctgcctgctgcttggccccatctcatgggcgtcatcctcagcactcacgtgatgggagagttttgtaggagctgtgagtcccaggtgcctgcgtgtgctgtgatgttatctcatgcagtccagtgaggggggactcccattagtctcctttttttgttttgttttgagacacagtctcacttcattacccaggctggagtgcaaggcacgatcttggctcaccacaacctccacctcccaggttcaagtgattctcctgcctcagcctcctgagtagctgggattncaggtgcgcaccactncgcctggctaatttttgtatttttngtagagatggggtttctccatgttggtcaggctggtcttgaactcccgaccttgtgatccacccncctcggcctcccaaagtgctgggattacaggcgtgagccaccgcgcccggccatgattctccttctgtgggtggaggaactgggcactgggagcgtgaaaaccttgcccaggtggcagagccagctttggacgcaggtctgacttcctacctcactccccttgccttgacagacacagtaattcagagttgaacttggaacagagtttattttccatcactgtaaaacattctcagtgaggttactggcattaaaaaggtgggagaaatggaagaaaatggggttgaagaaaaaaaaagcctttgctcttgacagctaggcagccacagcggaggccgccaggctgcgagggcagcgtatgggggcaggggagggtctctgtaggtgggagagggcctgggggctgggaggcagcctggccttgtgccctacaggagggacctcctgggactttatggaagcctgtcttgcctttgacttgcaatgaaaatgcccctcatcattgggagtggggtcgggtgggggtccccagtggccagatcacgtggggtccagagagcagacatctgtagccctgatcttggcggccagtgaccacggccaagcagggcctgtcttttgcctggtacaaggcttgatgagaagagacccctgcccatcctcagtggcctggcagccaggggtgaaccccaggggaagctgggacactgtcccaaaggcccggcgccctactgtgctgcctgagcccgtggcaccgtggggcccaaggtggtgatgatttctctgctcttcccacggggcagacagcaggacacatcctggagacaaggttggggagacaaacaggtgcccaggtcagggctgatcacagcagttacaaaagcatcccgtgaagacggggctgcaagacggtgctggcaaaggaacaggacccaggaagaccaggcttgtcctgtggaggggccgggtcttggcagggggcaagcagatgtccccagtttttgctggtgatcaacaagtgaggccgctgctccattctacacaggacagcatttccaggggtttccagtattctgtctagattcataaaggtcaaaggccttgagaatctatgtgtgcctttctatcttaggtaaagaagagaaagagaaagcaaattctcgttactcctctttcaaaaagttcattaaaagccaggctggcagctcacagtgctataatcccagcactgtggaaggcctaggcaggaggattgagaggagttccagaccaacctgggcaacaccgtgagaccccatctctac

SEQ ID NO: 354140 - DNA, 4987 bp, Homo sapiens
  misc_feature (2558)..(2558): n is a, c, g, or t
  misc_feature (2839)..(2839): n is a, c, g, or t
  misc_feature (2844)..(2844): n is a, c, g, or t
  misc_feature (2846)..(2846): n is a, c, g, or t
  misc_feature (3604)..(3604): n is a, c, g, or t
  misc_feature (3620)..(3620): n is a, c, g, or t
  misc_feature (3645)..(3645): n is a, c, g, or t
  misc_feature (3710)..(3710): n is a, c, g, or t
agagacgagatctcactgcgttgcccaagctggtcttgaactcctgggctcaagcaatcctcccacttcagccttccaaagtgctgggattataggcgtgagccacagtgcccagcccctgctaaatgttttgtaggggaaccttaggagccctgtgaggccttcattttcctattagaaggatttcccttgccctcttgctgtgagttcctagagatcgtgctttctctgtctcaggacctgggatccagttggaggacggcggtgatggcagggaggatgccccgttgagaatggagtggtaccgagtgctctcggcacgatgccaggggcctggccacccgctcccaggtcagaggccagccccagtcaggggcttggtcaggcctgatcagccaagaggcggccccccaccaggaagacgggcttcccatggggctgacaagccgtacacctgccccgaatgtggcaaaggcttcagcaagacgtcccacttgaccaagcaccagcgcacacacacgggcgagcggccttacaagtgcctagtctgtgggaagggctttagcgaccgctccaacttcagcacgcaccagagggtgcacacaggcgagaagccctacccgtgccccgagtgtgggaagcgcttcagccagagctccagcctggtcatccaccgcaggacacacagcggggagcggccctatgcctgcacccagtgcgggaagcgcttcaacaacagctcgcacttcagcgcccaccgccggacgcacacaggtgagaagccctacacctgcccggcctgtggccggggcttccgccggggcaccgacctgcacaagcaccagcggacccacatgggggcaggctccttgccgacgctccagccggtggctcctggaggccccggtgcaaaagcctgatcaccatgcctgaaactccctttccaggactctcatccctgggcacagaattcaggaaactgctagacagcctggtccgaaagcattgccagctgcccgtttcctcccatggcccagtatgaggccagcaggggacatttgggatgcccaggccgcagaggaagctgggcactgggtgcagaacaagggcaaggacaggctctgagtgtccagtggcagccagaacaggtgacacagagcaggggcttcagccacagagacacactcaggaggccagaagccgacactcaaggtgttcgtggggctggctcctgaagggcctgggagggtccatcagctgcctccagcatccagtggctgctggcatacagcctcatccccacgtcccaacccctctcctgtgtgtctgtgaccctgtgcgctgtctctgtgtgtaccccccacctgctcccccccccttttttttttgagacggggccttgctgtgtcccccaggcgggaatacagtgccatgatcatagctcactgcagcctcgaatccctgggctcaagtgttcctcctgcctcatcctcctgagtagctggggttacaggtgtgtgccgccatgcccagtctcttttttggtagggccaccactcactgggtttagggttccccaatacactgtgacctcatcttaactaattatatcatcaaaacccgtgtttccaaataaggtcacattctgaggtctgggtgcacatgaatttgagggacccctcgtctgctgcagggagccctgctgtaccccagccttcccaggacgtggtctccagcttcttcatcctgccagagtttccaaatggagcccggggctctgcagcattccagtcccctttgcagatccatagctgctctgcagggcggaagacacctggggcgggaaagcacccctgagttccatcttcctgacatgtcgcctgggatgtgacgggcctgacatctccccagggccggggcccagggctgcctttgctcctggccccttagtgtctggaatgtggccttccacggttgccccactttgtctttctaaggtaagaagccttcaccttccagcttttgtctggcctgtgctgcgtgggagccactggtctgtgcacatccacggtgggtgagtggccaagacaagcagtgtgatagagtccttggtgggtttagtcatctcggaagtcgtagggcagctatggaaaccactgggttctggaacgttccagccaggcagtggttgttcctcataggtaggtggccttggccttcatcccagcctgggatgctccattgcatttgtcacctagtcactgtatatacgtgcacatttgaccttttggcacagcccaggttccaggtgcgtgacctgccctttttctcattcccttaactgacattatttagtgtcagaggccgagcacagtggctcccacctataatcctagcactttgggaggccaacgcgggtggattgcttgagcccaggagttcaagagcagcctgggcaatatagaaagacctcttccctaccaaaaaaaaaaaaaaaaaaaaaaagccaggtgcagtggctcacgcttgtaatcccagcactttgggaggccgaggcnggtggatcacaaggtcaggagatcgagaccatcctggccaacatggtgaaaccccatctctactaaaaacacaaaaattagctaggcatggtggcgtggcacgtgcctgtagtcccagctactcgggaagctgaggcaagagaatcacttgaaccagggaggcggaggttgcagtgagccgaggtcgcaccgttgtactccagcctggtgatagaacgagactccacaaaaaaaaaaaaaaattagccaggcatgatggggtgtgcctgtagtcccagctncttgngnggctgaggctggaggatcacttgagcccaggaagttgaggctgcagtgagctgtgattgtgccactgcactcatcctggaagacagagtgagatcctgtctcagataaaataaacaattttttttttaagtcattgcttctggcccctgtgtgctctgtcctgtgtctgcagaatggggctgcctggttgagggacggcttttaccttctagactagctctgggatctctcatggggcatgaggtacccagctagatgtggccaggccacactccaggagctagcaaagcacccagcgttgctgacacccatctccccagcgcagcctgagcccccaggcccctctctcatatccaggcctgtgctggaggtggcggcctctgggggagtgtggttggggtctgcccacttccctccccctgccgaggctgtggcctcccgctggctgctgcttggccccatctcatggtcgctgcctgctgcttggccccatctcatgggcgtcatcctcagcactcacgtgatgggagagttttgtaggagctgtgagtcccaggtgcctgcgtgtgctgtgatgttatctcatgcagtccagtgaggggggactcccattagtctcctttttttgttttgttttgagacacagtctcacttcattacccaggctggagtgcaaggcacgatcttggctcaccacaacctccacctcccaggttcaagtgattctcctgcctcagcctcctgagtagctgggattncaggtgcgcaccactncgcctggctaatttttgtatttttngtagagatggggtttctccatgttggtcaggctggtcttgaactcccgaccttgtgatccacccncctcggcctcccaaagtgctgggattacaggcgtgagccaccgcgcccggccatgattctccttctgtgggtggaggaactgggcactgggagcgtgaaaaccttgcccaggtggcagagccagctttggacgcaggtctgacttcctacctcactccccttgccttgacagacacagtaattcagagttgaacttggaacagagtttattttccatcactgtaaaacattctcagtgaggttactggcattaaaaaggtgggagaaatggaagaaaatggggttgaagaaaaaaaaagcctttgctcttgacagctaggcagccacagcggagggggcaggggagggtctctgtaggtgggagagggcctgggggctgggaggcagcctggccttgtgccctacaggagggacctcctgggactttatggaagcctgtcttgcctttgacttgcaatgaaaatgcccctcatcattgggagtggggtcgggtgggggtccccagtggccagatcacgtggggtccagagagcagacatctgtagccctgatcttggcggccagtgaccacggccaagcagggcctgtcttttgcctggtacaaggcttgatgagaagagacccctgcccatcctcagtggcctggcagccaggggtgaaccccaggggaagctgggacactgtcccaaaggcccggcgccctactgtgctgcctgagcccgtggcaccgtggggcccaaggtggtgatgatttctctgctcttcccacggggcagacagcaggacacatcctggagacaaggttggggagacaaacaggtgcccaggtcagggctgatcacagcagttacaaaagcatcccgtgaagacggggctgcaagacggtgctggcaaaggaacaggacccaggaagaccaggcttgtcctgtggaggggccgggtcttggcagggggcaagcagatgtccccagtttttgctggtgatcaacaagtgaggccgctgctccattctacacaggacagcatttccaggggtttccagtattctgtctagattcataaaggtcaaaggccttgagaatctatgtgtgcctttctatcttaggtaaagaagagaaagagaaagcaaattctcgttactcctctttcaaaaagttcattaaaagccaggctggcagctcacagtgctataatcccagcactgtggaaggcctaggcaggaggattgagaggagttccagaccaacctgggcaacaccgtgagaccccatctctac

SEQ ID NO: 354141 - DNA, 407 bp, Homo sapiens
tgtgccatgatgttgcttctcaaggattcagccttgggcatgcatacagtcaccctgagatgacgatggtggcagggctctccttcactgtctctttcactgatcacacccaggtttaagctctgctgattgctgattgattgctctcattttcaaaatgtcgtggggcatcaattgtctattcagagaatcaattcagtttgggctcttttacgggtatagttatagacctagtgtacacctagcaggtagagttttttgagatcagtgtttgcgcttcattctgaccccaggagggctcttcttagctatttctgtttcctgttctctctggtaaaccaggcagcccacagtttaacttatatcgctaatctaccaatttcttcttcattgcttttaccacagcc

SEQ ID NO: 354142 - DNA, 4555 bp, Homo sapiens
aggctgggaggtgggactgactgagtcttccgtgtgtcgccgccgttgccgcctcagcttcagcctcgttactcctgcggttctgtggctgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattgtctggcccctctgtggaggagctggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacatta

SEQ ID NO: 354143 - DNA, 4840 bp, Homo sapiens
cgaatcctttaaaaccagtatctagaaattacgttctaatcttttttttcccagaaattgagtctgctaatctttcatctgtttgtcatatatataacaaatatttttaatcaaagaagtgataaatatatctagcatttagtagttgtcattaattttagcttgtatgtgtgtgtgtatatgtaaatatattttttttaggattatcgtatttattgactagtattcaaatatatctattttgatgttgttcaaaacagtagaccaaaggaggcacattaaattagtaccaaaatatattccatgaattgctgaaaatttgcttaaatttgtttcttagcttctcaatatccagaataaaaagggaaataattatgtaaaataatcagtgcccatacaatagaaacaatactattcatcatttcctcaagagaaacaatttctctggtgctaaggtaggtttttatttacgtcctcacaaaagggacaaagggggtatagggaataatgtcttccacatattgtgaacaaatgtaaccatgttttcataggatttgtggattctgtaaaagcagttctgctcaggataaatgcaagttttcagtgtttacgtggtttttttgatctataaataacagttaaaatgtctattggggtccttatttaactctcaaaagggttttagaagtaaatagcagattcaactatccattgaagccacttttactaatatgtgataacatgagcttagagtagactacttttcttactatactccatatcagggtaacccatggcgtgcaattattttatctagaagtagttccaagatgttatggtactagttcaaaagaactacatccagatctttgtgttccattttatagagatgatacattgttgaactgtaggcttttgtgcattttcaggaacatggtctagtgctaaagagtttttattttcattaaattatatgcttttaaaaattacataggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacatta

SEQ ID NO: 354144 - DNA, 4236 bp, Homo sapiens
aggctgggaggtgggactgactgagtcttccgtgtgtcgccgccgttgccgcctcagcttcagcctcgttactcctgcggttctgtggctgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatcatgcccggcgaatttttgtatttttaatagagacggggtttcaccacattgtccaggctggtctcgaacccctaacctcaggttatccacccaccttggcctctcaaagtgctgggattacaggtatgagccactgcacctgaccaaaaccaactttttaaaccagaaagtgtctgctttttttttctcctttctttcaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactaccatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacatta

SEQ ID NO: 354145 - DNA, 2979 bp, Homo sapiens
ttcagatctaagtatgtgtagacacgggatcctctaaagtctgaattgcatggatgatatctcgcgacaggatggtgttcacactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacatta

SEQ ID NO: 354146 - DNA, 2539 bp, Homo sapiens
agctgcccccgttatgtagatactgtggagatctagaatatatgagaatggaatagcagaactggcttctgggtgtcactactggaggagcttgaccttggctggtgcccaactttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaaaaaaaaaaa

SEQ ID NO: 354147 - DNA, 1916 bp, Homo sapiens
ttgtaacctgctaggcaaagtcacaatgacctgcagaatattaaatcagagaggaggcactccatgtttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaaaaaaaaaaa

SEQ ID NO: 354148 - DNA, 1852 bp, Homo sapiens
aggctgggaggtgggactgactgagtcttccgtgtgtcgccgccgttgccgcctcagcttcagcctcgttactcctgcggttctgtggctgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaagtctggcatagaagattaaagaatcaaaaaagtgccaaggaaggggtgacagtgcttataaacgaagacaaagagttggctgagctgcgaggtctggcagccggagtaggcctggctaatgcctgctatgcaatacagtatgtagctttggccatcattatggagcacctaggcaaaggtactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattc

SEQ ID NO: 354149 - DNA, 221 bp, Homo sapiens
tagatttgaggccaaccataagtgtaagactggattgatggaatagggattacataatcaggatctcaaatctattgcatttatgataatgtattatatctagttgagtttaatatttttttattagcctgtaaataaagatggcatcttctacattaaaatgatattgatctcatttttttaaataaacattttgtttccttgacgttaaaaaaaaaaaa

SEQ ID NO: 354150 - DNA, 4594 bp, Homo sapiens
aggctgggaggtgggactgactgagtcttccgtgtgtcgccgccgttgccgcctcagcttcagcctcgttactcctgcggttctgtggctgtgctgctggcgttaacggcgcgaggtgaagggaggtgacggagtgtgcccgcgcgcgcgggggtcccctcagtcccagcagttcccttcgtgcgcggggggcggcgagggtcttcagcagtcgggagaggcccttgacggcgccatgtcggcgggcggtccatgcccagcagcagccggagggggcccagggggcgcctcctgctccgtgggggcccctggcggggtatccatgttccggtggctggaggtgctggagaaggagttcgacaaagcttttgtggatgtggatctgctcctgggagagatcgatccagaccaagcggacatcacttatgaggggcgacagaagatgaccagcctgagctcctgctttgcacagctttgccacaaagcccagtctgtgtctcaaatcaaccacaagctggaggcacagttggtggatctgaaatctgaactgacagaaacccaagcagagaaagttgttttggagaaagaagtacatgatcagcttttacagctgcactctattcagctgcagcttcatgctaaaactggtcaaagtgctgactctggtaccattaaggcaaaattggaaagagagcttgaggcaaacaaaaaagaaaaaatgaaagaagcacaacttgaagctgaagtgaaattgttgagaaaagagaatgaagcccttcgtagacatatagctgttctccaggctgaagtatatggggcgagactagctgccaagtacttggataaggaactggcaggaagggtccaacagatacaattgctaggacgagatatgaagggacctgctcatgataagctttggaaccaattagaagctgaaatacatttgcatcgtcacaaaactgtgatccgagcctgcagaggacgtaatgacttgaaacgaccaatgcaagcaccaccaggccatgatcaagattccctaaagaaaagccaaggtgttggtccaattagaaaagttctcctccttaaggaagatcatgaaggccttggcatttcaattacaggtgggaaagaacatggtgttccaatcctcatctctgagatccatccggggcaacctgctgatagatgcggagggctgcacgttggggatgctattttggcagtcaacggagttaacctaagggacacaaagcataaagaagctgtaactattctttctcagcagagaggagagattgaatttgaagtagtttatgtggctcctgaagtggattctgatgatgaaaacgtagagtatgaagatgagagtggacatcgttaccgtttgtaccttgatgagttagaaggaggtggtaaccctggtgctagttgcaaagacacaagtggggaaatcaaagtattacaaggatttaataagaaggcagtaactgacacacatgaaaatggagacctgggcactgcaagtgaaactccgctagatgacggtgcttcaaaattagatgatctgcacactctgtatcataaaaaatcttattaaattgaccatatctccagacaagattgttaatcagactattctgaatttggggcactggggaagatggtgacaaagactacaaaatcaggggaggctgtttgttgcctaaatgaaaggcgggtacctcagggcttcatgtgaacaattctcaatgcataaaacaccctgttttctgtggtagaccataattagctattgcatgtaaagcaattttgattttcttgaacttgtaagcaccaaagcatgtgtttcccaaaggggtattactgggctcttaagtaccaaatgaaaccctactgttttacttggttccttttccctttagtaggaggacagtgctaactggaattttataaggagtaccctttaaaatacagagagtaagtgaattcatattttatattctagaatgttaactgtggtatttcagaagacagagcttgactcaatgaattgtagaaatataggcttgacttaatttttgtaactgaaaggctttagacttaaaaaaatttattgtgcatcctaaaatctaaaccaattattaatgatcatttattgtaatgagtttgcatttcagctttattcaatgcagtacaaaatagttttctttaagcagtcttttatcaatcaatgctgcactagaaatagattctcaaaagttactaaacattttactttttttgttttttaaaagaaatgcagatgagtgtaaaacatctgttctcaattatgttgatctgtgtgcgcagtactggagcatttacccattcatgttgagcctcaaatgcttgttttctggggtccacaaaagacagttttatacattttgagttgttcataaagtttgtcttgtgatagtcctggcacttaaagacaaatttttctggtagtaaaagttcagatttattactatgtcatgaaacacagtacattcaaatcaaacggcagttttctttctaagtaaatgatttccagtcatctaaaaggtgggcaagatgagataaagacattttgatacagtaattgttttggttgggttttcatgtcagtttatgtttgactaaagctctcttcatatgcaggtttataaatttgttaggtctgttgtcccatgattaaacatggagtgcctcctctctgatttaatattctgcaggtcattgtaacctgctaggcaaagtcacaacattgcattaaagaggtgatagctttgctaatatcactgttttaaaggacgtacagttaaaggaatattaagtgggagaaagcctacaaggcttttagaatattatcagtatcttcatttctggtattcagatgttatgtgataaaacacattttttttggctttcccagatacactatatatttgttcaagggtaaatctataaaatgtatatactttattttgtggttttgctatttataaatttaatgttttaactgttgctcatttatggtttgttttgggtggtggtgttcatctgtatatcaccatgttaatttgtaatggaagtgcacttcgtagtgtatattgttactgacattaaaatactttatagcattgtctctgagcaaaagctagtatttaattgtacaaatgaataagcaagttacatgttattgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtccattgtagcagacccgaaaacctttttgctgtgacatgaaaccatgttattcttatcttcttaaaacacagcctgggatggaatggccatggcatttttttcagagaacatcctttatctgctatgactgaatccttaggaaatgtaagctataaccctttgattttcaagaactaccgaataagtgtatgaagaggtggttttttaaaacttcaagttggaatttttatgaggtcactgtgtaatttgaagaattgtgtgagattgtcatgatataaattccttttaaggactgataaatagaatgaaaagtttccaggtagtttaaaactccacaggtcagtttccttttcattcctgcttcactgtggtttataagcctacgggagagcaccgttgctcagatgctactgtgagcttcctgtccggtgttagaaagtaactagttaaaagttcattttagaatgtatggtttttggggatgaactaagaattagttattagttccaaaggactgagaaccaattttaatattttcacatttataggaaagaaattcatatgtccctgaaacttctaggacaaaaccaaacaagtaaggagggaactgttgcaaagccatttcatcgagaaggggacagaaggagaaatacacacatgtatacacaaacagaatggttgagaaaacgttttaataaaatgtgagggttgtatgtgtgcgtgtatatatttacacttaacctctaaaattctcttctacagtatctctgttatgaatatgatggaaaagcaacattttggtggtgagactattgttaaaataaatttgagaaagacgaaaattttgtgagtcttgataattacaagtcaacagctatcgaaagttagcacagcttgtctgtggtgctgtttttttccccactgcagtggacttatgctgttttcatgtttagaaacaaaaaggtttcatgtgattcatgtgtaagatgcacagtatttgacatcctgattatgtaatccctattccatctatccagtcttacacttatggttggcctcaaatctattgcatttatgataatgtattatatctagttgagtttaatatttttttattagcctgtaaataaagatggcatcttctacattaaaatgatattgatctcatttttttaaataaacattttgtttccttgacgttaaaaaaaaaaaa

SEQ ID NO: 354151 - DNA, 401 bp, Homo sapiens
tcactcccactgccccctgcctctctcctcctaacccagccagttcaggcttctaacccagttcaggctcctaacccagacagttctccggcaaggtttctgcaactaagaaaagtaaaccccagagacagaatgaaagagccgggagttggaaggaccaagagcagagacagagagcaaggaccgaaactgcttcttcatgacaccaaaatacaaagtaaaacatgcagtcagccattcacgtgatcgagagctgagtcggagatgtgcagcccaaataccacaacgactcgctgcatttttcactttccgtctaatgtttcgaaatcaaggcactgacgtgaagatcaaagacggtataagaaagaaagcaagagacagatgacagagtcctccccccc

SEQ ID NO: 354152 - DNA, 5017 bp, Homo sapiens
  misc_feature (112)..(112): n is a, c, g, or t
gattataaccagtttttttttaacctatatgaatattcagtaggacatgtgaaagctgtgtgggatcaggacagttttcttgtgtgataccatcttgcaatgtgcaagacanggagcctccttggctcctctcccccaatcatttgacaacaaaattgccccgaacatttccaaattgctccttagggagggtgccattctggttggggaaccactgtggtggtctgaatgctttacctgttccctgttccccagccttaccttgggctgttctcccctcaccaggctcaaagatgccctgggccttcccagttcttctccaagccaatctctttcctctctcaggacattctggtgctcttttctttgcctggaaaactgtccacttcatgtctggataacttttcctgaacctttggatctcagcattgccaaattcccagtctaatttaatactttgtttagtttttccacaggactctgtgcttttctgcaatggtacttatcagactgggatttctacctgttttattcttgctatgtcaagcgtgtttattacctgtctccctcaactttcagttccctgagagcagggaccatgcccatctcgtccaccgcttgtttacccagcactcacgaagatgcccggaacttagcatccttagatgaacgtacgtgcctggcaaacaacaaacatttcttaggcaactgaaaggctgatgggattccacagccaattgggagaaaagcgctctcgagggtgggggtatgctttttccagggcagatggtgttcagcccaagttacggggcagctttggtccactctggatttgcctggattcgcgtatgtgggggcgaacgcgtcttatcggggggcggccggttggggccaggcagcccggatcccagccgaggaggtgcgcggtgctgagaggccgtgggagcgaccatagagaacgcgcgggcggagcgagcggccggatgcggtcaccatagagacgggtgactgacaggcagcggaagaggaagctgcggacaggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaactgtt

SEQ ID NO: 354153 - DNA, 3081 bp, Homo sapiens
  misc_feature (112)..(112): n is a, c, g, or t
gattataaccagtttttttttaacctatatgaatattcagtaggacatgtgaaagctgtgtgggatcaggacagttttcttgtgtgataccatcttgcaatgtgcaagacanggagcctccttggctcctctcccccaatcatttgacaacaaaattgccccgaacatttccaaattgctccttagggagggtgccattctggttggggaaccactgtggtggtctgaatgctttacctgttccctgttccccagccttaccttgggctgttctcccctcaccaggctcaaagatgccctgggccttcccagttcttctccaagccaatctctttcctctctcaggacattctggtgctcttttctttgcctggaaaactgtccacttcatgtctggataacttttcctgaacctttggatctcagcattgccaaattcccagtctaatttaatactttgtttagtttttccacaggactctgtgcttttctgcaatggtacttatcagactgggatttctacctgttttattcttgctatgtcaagcgtgtttattacctgtctccctcaactttcagttccctgagagcagggaccatgcccatctcgtccaccgcttgtttacccagcactcacgaagatgcccggaacttagcatccttagatgaacgtacgtgcctggcaaacaacaaacatttcttaggcaactgaaaggctgatgggattccacagccaattgggagaaaagcgctctcgagggtgggggtatgctttttccagggcagatggtgttcagcccaagttacggggcagctttggtccactctggatttgcctggattcgcgtatgtgggggcgaacgcgtcttatcggggggcggccggttggggccaggcagcccggatcccagccgaggaggtgcgcggtgctgagaggccgtgggagcgaccatagagaacgcgcgggcggagcgagcggccggatgcggtcaccatagagacgggtgactgacaggcagcggaagaggaagctgcggacaggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccatatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaactgtt

SEQ ID NO: 354154 - DNA, 182 bp, Homo sapiens
  misc_feature (3)..(3): n is a, c, g, or t
  misc_feature (15)..(15): n is a, c, g, or t
  misc_feature (29)..(29): n is a, c, g, or t
ggntcccccgggctncaggattcggcacnaggagaattgttgctgtccaccatcttgccttgcccttcctggggctgaggcagacaaaggaagggcaaggcaagatggtggacagatagagaattgttgctgtattttttaaatatgaaaatgttattaaacatgtcttctgccaaactgtt

SEQ ID NO: 354155 - DNA, 5435 bp, Homo sapiens
  misc_feature (112)..(112): n is a, c, g, or t
gattataaccagtttttttttaacctatatgaatattcagtaggacatgtgaaagctgtgtgggatcaggacagttttcttgtgtgataccatcttgcaatgtgcaagacanggagcctccttggctcctctcccccaatcatttgacaacaaaattgccccgaacatttccaaattgctccttagggagggtgccattctggttggggaaccactgtggtggtctgaatgctttacctgttccctgttccccagccttaccttgggctgttctcccctcaccaggctcaaagatgccctgggccttcccagttcttctccaagccaatctctttcctctctcaggacattctggtgctcttttctttgcctggaaaactgtccacttcatgtctggataacttttcctgaacctttggatctcagcattgccaaattcccagtctaatttaatactttgtttagtttttccacaggactctgtgcttttctgcaatggtacttatcagactgggatttctacctgttttattcttgctatgtcaagcgtgtttattacctgtctccctcaactttcagttccctgagagcagggaccatgcccatctcgtccaccgcttgtttacccagcactcacgaagatgcccggaacttagcatccttagatgaacgtacgtgcctggcaaacaacaaacatttcttaggcaactgaaaggctgatgggattccacagccaattgggagaaaagcgctctcgagggtgggggtatgctttttccagggcagatggtgttcagcccaagttacggggcagctttggtccactctggatttgcctggattcgcgtatgtgggggcgaacgcgtcttatcggggggcggccggttggggccaggcagcccggatcccagccgaggaggtgcgcggtgctgagaggccgtgggagcgaccatagagaacgcgcgggcggagcgagcggccggatgcggtcaccatagagacgggtgactgacaggcagcggaagaggaagctgcggacaggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcagaactgtcccaagaaagcccaagggtagaagggagaattctcaagttgaacgtcaggcttggcagaggtggagtgtagatgaaaacaaaggtgtgattatgaagaggatgtgagtcctttgggtgtaggagagaaaggctgttgagcttctatttcaagatacttttacctgtgcaaaaagcacattttccacctccttctcatggcatttgtgtaaggtgagtatgattcctattccatctgcattttagaggtgaagaataacgtacaagggattcagtgattagcaagggacccctcactaagtgttgatggagttaggacagagctcagctgtttgaatctcagagcccaggcagctggagctgggtaggatcctggagctggcactaatgtgaggtgcattccctccaacccaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaactgtt

SEQ ID NO: 354156 - DNA, 5234 bp, Homo sapiens
  misc_feature (112)..(112): n is a, c, g, or t
gattataaccagtttttttttaacctatatgaatattcagtaggacatgtgaaagctgtgtgggatcaggacagttttcttgtgtgataccatcttgcaatgtgcaagacanggagcctccttggctcctctcccccaatcatttgacaacaaaattgccccgaacatttccaaattgctccttagggagggtgccattctggttggggaaccactgtggtggtctgaatgctttacctgttccctgttccccagccttaccttgggctgttctcccctcaccaggctcaaagatgccctgggccttcccagttcttctccaagccaatctctttcctctctcaggacattctggtgctcttttctttgcctggaaaactgtccacttcatgtctggataacttttcctgaacctttggatctcagcattgccaaattcccagtctaatttaatactttgtttagtttttccacaggactctgtgcttttctgcaatggtacttatcagactgggatttctacctgttttattcttgctatgtcaagcgtgtttattacctgtctccctcaactttcagttccctgagagcagggaccatgcccatctcgtccaccgcttgtttacccagcactcacgaagatgcccggaacttagcatccttagatgaacgtacgtgcctggcaaacaacaaacatttcttaggcaactgaaaggctgatgggattccacagccaattgggagaaaagcgctctcgagggtgggggtatgctttttccagggcagatggtgttcagcccaagttacggggcagctttggtccactctggatttgcctggattcgcgtatgtgggggcgaacgcgtcttatcggggggcggccggttggggccaggcagcccggatcccagccgaggaggtgcgcggtgctgagaggccgtgggagcgaccatagagaacgcgcgggcggagcgagcggccggatgcggtcaccatagagacgggtgactgacaggcagcggaagaggaagctgcggacaggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcagaactgtcccaagaaagcccaagggtagaagggagaattctcaagttgaacgtcaggcttggcagaggtggagtgtagatgaaaacaaaggtgtgattatgaagaggatgtgagtcctttgggtgtaggagagaaaggctgttgagcttctatttcaagatacttttacctgtgcaaaaagcacattttccacctccttctcatggcatttgtgtaaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaactgtt

SEQ ID NO: 354157 - DNA, 4920 bp, Homo sapiens
  misc_feature (112)..(112): n is a, c, g, or t
gattataaccagtttttttttaacctatatgaatattcagtaggacatgtgaaagctgtgtgggatcaggacagttttcttgtgtgataccatcttgcaatgtgcaagacanggagcctccttggctcctctcccccaatcatttgacaacaaaattgccccgaacatttccaaattgctccttagggagggtgccattctggttggggaaccactgtggtggtctgaatgctttacctgttccctgttccccagccttaccttgggctgttctcccctcaccaggctcaaagatgccctgggccttcccagttcttctccaagccaatctctttcctctctcaggacattctggtgctcttttctttgcctggaaaactgtccacttcatgtctggataacttttcctgaacctttggatctcagcattgccaaattcccagtctaatttaatactttgtttagtttttccacaggactctgtgcttttctgcaatggtacttatcagactgggatttctacctgttttattcttgctatgtcaagcgtgtttattacctgtctccctcaactttcagttccctgagagcagggaccatgcccatctcgtccaccgcttgtttacccagcactcacgaagatgcccggaacttagcatccttagatgaacgtacgtgcctggcaaacaacaaacatttcttaggcaactgaaaggctgatgggattccacagccaattgggagaaaagcgctctcgagggtgggggtatgctttttccagggcagatggtgttcagcccaagttacggggcagctttggtccactctggatttgcctggattcgcgtatgtgggggcgaacgcgtcttatcggggggcggccggttggggccaggcagcccggatcccagccgaggaggtgcgcggtgctgagaggccgtgggagcgaccatagagaacgcgcgggcggagcgagcggccggatgcggtcaccatagagacgggtgactgacaggcagcggaagaggaagctgcggacaggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggctcagatccggaacctgaccgtgctgacccccgaaggggaggcagggctgagctggcccgttgggctccctgctcctttcacaccacactctcgctttgaggtgctgggctgggactacttcacagacagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaactgtt

SEQ ID NO: 354158 - DNA, 2190 bp, Homo sapiens
agagagagcctgagatgtccaggcgtgcaatgaacgagcagctggcagtggggctgggctaggccctgtataatggcagggcaggaagaggccgaccatacttaaatttaaagcaactacagggacaaaggtctttgggggtccaaagcaatcataaggtaagctcccagcacaacttgaatgcagctaaaggggtttgcaagtagactctgaggatcaggaagctccgcacagtgttcagacagaatagttttagctcctcctcaatagtgcctgtccactgaggaggcaaaaactctgaagtttctttacttctagaactgtcccaagaaagcccaagggtagaagggagaattctcaagttgaacgtcaggcttggcagaggtggagtgtagatgaaaacaaaggtgtgattatgaagaggatgtgagtcctttgggtgtaggagagaaaggctgttgagcttctatttcaagatacttttacctgtgcaaaaagcacattttccacctccttctcatggcatttgtgtaaggtgagtatgattcctattccatctgcattttagaggtgaagaataacgtacaagggattcagtgattagcaagggacccctcactaagtgttgatggagttaggacagagctcagctgtttgaatctcagagcccaggcagctggagctgggtaggatcctggagctggcactaatgtgaggtgcattccctccaacccaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaactgtt

SEQ ID NO: 354159 - DNA, 5564 bp, Homo sapiens
  misc_feature (112)..(112): n is a, c, g, or t
  misc_feature (5564)..(5564): n is a, c, g, or t
gattataaccagtttttttttaacctatatgaatattcagtaggacatgtgaaagctgtgtgggatcaggacagttttcttgtgtgataccatcttgcaatgtgcaagacanggagcctccttggctcctctcccccaatcatttgacaacaaaattgccccgaacatttccaaattgctccttagggagggtgccattctggttggggaaccactgtggtggtctgaatgctttacctgttccctgttccccagccttaccttgggctgttctcccctcaccaggctcaaagatgccctgggccttcccagttcttctccaagccaatctctttcctctctcaggacattctggtgctcttttctttgcctggaaaactgtccacttcatgtctggataacttttcctgaacctttggatctcagcattgccaaattcccagtctaatttaatactttgtttagtttttccacaggactctgtgcttttctgcaatggtacttatcagactgggatttctacctgttttattcttgctatgtcaagcgtgtttattacctgtctccctcaactttcagttccctgagagcagggaccatgcccatctcgtccaccgcttgtttacccagcactcacgaagatgcccggaacttagcatccttagatgaacgtacgtgcctggcaaacaacaaacatttcttaggcaactgaaaggctgatgggattccacagccaattgggagaaaagcgctctcgagggtgggggtatgctttttccagggcagatggtgttcagcccaagttacggggcagctttggtccactctggatttgcctggattcgcgtatgtgggggcgaacgcgtcttatcggggggcggccggttggggccaggcagcccggatcccagccgaggaggtgcgcggtgctgagaggccgtgggagcgaccatagagaacgcgcgggcggagcgagcggccggatgcggtcaccatagagacgggtgactgacaggcagcggaagaggaagctgcggacaggggctgtgaggtggcagcggctgcagcggcggagccggcgcctcagcgggcactggggtctgttcccccttccccgtccctgctccctgccaggcgcgtgcgggacgccgctcttggtccccacgcctccgccccgccccctcccgggacgccgggagaccccggccgtcctttatccggtgtccgccggcccccggccctgaaacccgggcctcctccccgagggccttgggcgtccctcctggtcctgcgctcgcggcctcgatgctgtctctggcgcggcctccgctcccgccgactggcctgagaacgaggtctgtgccccagtctcccagccgcgacctccgaccccgcctcgcagaacgacccgagctggtctcccgagcccccttctcagcagcccggtgacgtggccagtttatttctgttttgagacgaacggcgaagactcgcgtcgggtcttcgttctagggctagacttggtctctgatcgccgagaggtagcgcaggggctgtgggcccccggcaggggtcctgtcggaagctggccgcgcttctgtttgcgttcccaggaccctggcattgtctctagttgctgcttgtgctctctctttgcttttggtttgcttcatttggcccctggggccctggtaaaaccaggcaccgaatcgctcgcacacagagttccagtccccgcctgctgtctcctcagcagctggggttccgaggagaatgccctgcaagatggctccatcggccatggcgctcctgagaggctgtcagtgctgagtcaccgatctacctcattcgggtgggcagaacttatgtgtgccatgcgagtggctccagaccgctcctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggactcggtacatccagacagagctgggctcccgtgagcggttgctggtggctgtcctgacctcccgagctacactgtccactttggccgtggctgtgaaccgtacggtggcccatcacttccctcggttactctacttcactgggcagcggggggcccgggctccagcagggatgcaggtggtgtctcatggggatgagcggcccgcctggctcatgtcagagaccctgcgccaccttcacacacactttggggccgactacgactggttcttcatcatgcaggatgacacatatgtgcaggccccccgcctggcagcccttgctggccacctcagcatcaaccaagacctgtacttaggccgggcagaggagttcattggcgcaggcgagcaggcccggtactgtcatgggggctttggctacctgttgtcacggagtctcctgcttcgtctgcggccacatctggatggctgccgaggagacattctcagtgcccgtcctgacgagtggcttggacgctgcctcattgactctctgggcgtcggctgtgtctcacagcaccaggggcagcagtatcgctcatttgaactggccaaaaatagggaccctgagaaggaagggagctcggctttcctgagtgccttcgccgtgcaccctgtctccgaaggtaccctcatgtaccggctccacaaacgcttcagcgctctggagttggagcgggcttacagtgaaatagaacaactgcaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagcaccctgtggacactctcttcttccttaccaccgtgtggacaaggcctgggcccgaagtcctcaaccgctgtcgcatgaatgccatctctggctggcaggccttctttccagtccatttccaggagttcaatcctgccctgtcaccacagagatcacccccagggcccccgggggctggccctgaccccccctcccctcctggtgctgacccctcccggggggctcctataggggggagatttgaccggcaggcttctgcggagggctgcttctacaacgctgactacctggcggcccgagcccggctggcaggtgaactggcaggccaggaagaggaggaagccctggaggggctggaggtgatggatgttttcctccggttctcagggctccacctctttcgggccgtagagccagggctggtgcagaagttctccctgcgagactgcagcccacggctcagtgaagaactctaccaccgctgccgcctcagcaacctggaggggctagggggccgtgcccagctggctatggctctctttgagcaggagcaggccaatagcacttagcccgcctgggggccctaacctcattacctttcctttgtctgcctcagccccaggaagggcaaggcaagatggtggacagatagagaattgttgctgtattttttaaatatgaaaatgttattaaacatgtcttctgccaaactgttaaaaaaaaaaaaaaaaaaaaaaaaaaaaaaaaaaaaaaaaaaaaaaaaaaaaaaaaaaaaaaaaaaagggggggggggccaaaaattcccccggggggggccccactattatgagcgaacaccccccgcgtttggttggaaacaagaggggggccccccaaagagaggcgaggagatattataatacacagcagcgaaccgcggcggcggccgcgattaacaaccaccacacggctggagtggtggggaaaacaggcggttagtcccggggggccaagcctgctggtgggaagagacaaccaccccatcttccgccggggggggggaaccacaccttatgtgtgggccaaccgccctcctctcaacgcaagaaagatataattgacgcgccccccgcagacgaaaatatatttaacaaactggcggcagcgagtataagtacgtgggggctaacacccacaagccgcataattataggttgccgcgccggaagacaaatgtggcaaccaggaggaattatattagcacaacaattattcaccggggn

SEQ ID NO: 354160 - DNA, 305 bp, Homo sapiens
ccaagggcaaatctctggagaaagtcacaggtgtcagtcactagtcttgccctggcagcagataggggaggggtttgatgacttatacaaaggcatcaacagtgtctattgcagcaggcaggcattcgaggatgtagtaattgctttgtatttcctggacgttggctctttgggtgtttggcttgggagctatggtgaagaaaaatggtttctctcttcatcgctctctctccctccccacttcacctccagtcctttttgtttaaaatgaaacttcattttttgtatttcttctattgaggaaa

SEQ ID NO: 354161 - DNA, 1301 bp, Homo sapiens
ttaaataacttggaaaaactactggactggatggtctcttaagattgcaagtgccaagccttggcactctaggacccatcccttttaacagtagcatctatttttagactagacaaggatacctaagctgtattacaaatatagttccagacacatcatggtactctacatctagtccggttcctgatacctttaaccaatgctctggcctggccattcctgcagtgcctgtccttctcctttggcttatgctatcctcagcagcacatgcattatttgtaagcctcccttacccatttgatactacccaatcaagactctagtataaatgttctgtcccttcaagaaaccttccccagttggccattttcccaaagtacattttccactcttatggttcagtacactttgctttgtctggtagttttatgtgtaaagctcagaggactggatcttgggtttctttatagtaaaccatccaaatgccttgcattgtactatactgaaggtaacatggatccaagtcatatggcttaaaaattcttttctctttcaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataat

SEQ ID NO: 354162 - DNA, 820 bp, Homo sapiens
gccgacttgcgacggaggcagcgggtccgggtcgggggacctgagaaggagccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgaggtttggcgggcgcgggaccaatatgggcagggccgaggcgggattctccctctcgctgtgcctagaccgtactcctgctgcagttccggcagagagcgcggggagagcagcggcgggagctgcggcgagcacgccggccctggggtagatgcaacacatgagaggggatccaagttgcttgggtcggccccggcagcgacctgaacccgccgccctgcgggaggggtgtgcggagcgctgggctgtgctccggcaacttcactcctcccgccgccactggggaacgtagtgggggagacgcagaaggctaggcgaggggttctcaatgcgttcttccaagaaaactttttctcccttgaacatgaaggaatacgtgcttaccgtagaaacattgggaaaacatgggaaattattgtgtaaaaatggggggcgacgtgtgggagtctctcccggggcgaggggactgcgatttgctgtgctagccgggggcgagcggcgggcggcgctaccctggcggcccagaggggcggagagccacgcggcgccaagggctgagatttgaggaagtgggagctgcccgggcgggggcgtcccgctga

SEQ ID NO: 354163 - DNA, 484 bp, Homo sapiens
gtttcctcccagggccattgttaccacctgatcatttgagttttagtttctctagcagatgctggctaatgactgaccaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttgtaagtactgttgagaatttaaacagtgttcttgagggtttaagttgcaatgcacaggacaaaaattttcagccttgggtctatacaaaagggtatctcttaattatatcctcatcctccccctaaaagtatgttagaattctcaataaaatctgagtcttctccttttctcctaaatcccaaagttgtaaccccaaagagaaattccactcccttgatagcttaaaaaaaaaaaaaaaaaaaaaaaa

SEQ ID NO: 354164 - DNA, 1299 bp, Homo sapiens
  misc_feature (1263)..(1263): n is a, c, g, or t
  misc_feature (1265)..(1265): n is a, c, g, or t
  misc_feature (1268)..(1268): n is a, c, g, or t
  misc_feature (1299)..(1299): n is a, c, g, or t
gccgacttgcgacggaggcagcgggtccgggtcgggggacctgagaaggagccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataatggcntngtnggcctcagcggtggagctctgcggcccgaan

SEQ ID NO: 354165 - DNA, 769 bp, Homo sapiens
  misc_feature (24)..(24): n is a, c, g, or t
ccagaggaccccgactagtccaangatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataat

SEQ ID NO: 354166 - DNA, 1201 bp, Homo sapiens
gccgacttgcgacggaggcagcgggtccgggtcgggggacctgagaaggagccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataat

SEQ ID NO: 354167 - DNA, 751 bp, Homo sapiens
  misc_feature (14)..(14): n is a, c, g, or t
  misc_feature (22)..(22): n is a, c, g, or t
  misc_feature (34)..(34): n is a, c, g, or t
  misc_feature (41)..(41): n is a, c, g, or t
gcgtggttgggacnatcactcnaggctggtgggngctaacnatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataat

SEQ ID NO: 354168 - DNA, 455 bp, Homo sapiens
caaacttggtggcagatgtaattttataacatgaagcattttgtagtactgttgcctagactccagttggtaattaccaagtcttggaattactgttaaggccttacataatttctcttcatacaggtaacgctgataagtgcttttgttttccctcaactacctccaaaaccgttgaatatattctttgctgtctgcatctctttgagtagtattactgcctgcatacttgtaagtactgttgagaatttaaacagtgttcttgagggtttaagttgcaatgcacaggacaaaaattttcagccttgggtctatacaaaagggtatctcttaattatatcctcatcctccccctaaaagtatgttagaattctcaataaaatctgagtcttctccttttctcctaaatcccaaagttgtaaccccaaagagaaattccactcccttgatagctt

SEQ ID NO: 354169 - DNA, 918 bp, Homo sapiens
gccgacttgcgacggaggcagcgggtccgggtcgggggacctgagaaggagccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttgtaagtactgttgagaatttaaacagtgttcttgagggtttaagttgcaatgcacaggacaaaaattttcagccttgggtctatacaaaagggtatctcttaattatatcctcatcctccccctaaaagtatgttagaattctcaataaaatctgagtcttctccttttctcctaaatcccaaagttgtaaccccaaagagaaattccactcccttgatagcttaaaaaaaaaaaaaaaaaaaaaaaa

SEQ ID NO: 354170 - DNA, 1259 bp, Homo sapiens
gccgacttgcgacggaggcagcgggtccgggtcgggggacctgagaaggagccgggaggtgatccgcagcgctgcgacgggaccgcgcgattcctctcccacgcatctggcccgcgttcctgggcctcggcaccggatcccggcgggggtgtggacccagggcccactctccccggcgcggccagggccccccagcgtgcgagcgcctaggggatgccgagctgctcaagatgaggaggtgcgcggggccggggcggagcagtcgcgttccccgcgtgtgagcccccacccatccctggcgccagcgcttccccgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagtaacgctgataagtgcttttgttttccctcaactacctccaaaaccgttgaatatattctttgctgtctgcatctctttgagtagtattactgcctgcatacttatctactggtatcgacaaggagacttagaaccgaaatttagaaagctaatttactatatcatattttctatcatcatgttgtgtatatgtgcaaacctgtacttccatgatgtgggaaggtgaggctgccaaggagaagtacttaccaggactcttcaaaatgatacattaggacagtgagtaatttttggataaggtatgctgaagaatctcctgcagaagtctgatacatgattttcatgttaattgtaaatgttaattccctcttgcaagggagacatatcctagatcactttgctttttctttaaggagctgatgttgcacctaaacattccaacccttaaagctaaaacagcacaaaaaaatttcacttttgaaatgaaatttttataattgtatggcaaaaggctatgtaaaaacaaatcttgcatcttaagacaaatattcttttatttctgttaaactgaatatacaattgttccctaggcaaccaacttttgcttataactacaatttaatttcacgttgacaaaacacagtgaaaagacaactttgtgaagatctaattacaataataaataaaataat

SEQ ID NO: 354171 - DNA, 325 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgaggtgagagtgagctggggggaagaggagcggcaggccctgcttgggcctcgctcgggagctgtccgggaccaggagctgtccccgaccaagagctctcttcaaccaggggaagaaaggggagctgtccccggccgggagctgtccccgactgggagctgtcccaagcttagaacagacttcagaactcgctttt

SEQ ID NO: 354172 - DNA, 6366 bp, Homo sapiens
ccttgagtggtaactttatcttagtccaggtgattccagttgcagcagtagctaggtgccctgcgataactctctccccttgagggtttccagtgtgggaagttgtcatttaggcgcgccaaaagtggtctggcctctcgtgcttcttgagatcccttccgggctctggtctatcttgtctccttagctgggggcctacagtcatctagagtaaaagggatggttaaaaaaaaaaaaaaaaggcaatcggagacaagaatgccagaggagagacattaaccatgtaatttgaatttaaaatgctcatggaatatgggaaattcagtgctgagccatgtgagcagggttacttgctagggtcctggaacgcacctgtctggccaggagtttcttaagatatctctggtatcttctgttctagaccttaggtgtagccggctgtgggctggggattatccagctcccctttcccatatggagccttaagggttagtgtatcctgatagggggatccctaggactttcatccaggtctcttctttctttcatagtgaagatgaggcccaggatgttgtactggcatgagtgccaagagaccatggcccttttcatttcctattctctttcccctgatcccaaccattgtttgcaaagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354173 - DNA, 5689 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354174 - DNA, 5295 bp, Homo sapiens
  misc_feature (13)..(13): n is a, c, g, or t
agtgacccggcancggtcaaacatcacagccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354175 - DNA, 6323 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354176 - DNA, 6255 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354177 - DNA, 5805 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354178 - DNA, 5752 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354179 - DNA, 6004 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggtgagaggacatccctttctgtgctcctacctgcagttgtgccagtggctcttcagaggacccttcctctagctcttcatttgtttactgtggggtcaggtgacaggttggggtaaagggtgaagaggatacaccgtaccatgtgcccaccctatctatctatctcccaggaatgctggcactggagatgctgggtcgccgggcacacaacgatcaccccaacaacttctcccgctcccccccctacactgatgatgtcaaatggttgctggggctggcagcaaagctgggtaacacctcccctccctaggaccattgccccccccccacctgctctccccaccttccttatcccagacctccttcctagctcttgctcagagttgaggccttggtcgggtatgtgtgcgtgcgcggggggcggagggttacctcagctcctggggtggagggaggct

SEQ ID NO: 354180 - DNA, 5137 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtactgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggtaacacctcccctccctaggaccattgccccccccccacctgctctccccaccttccttatcccagacctccttcctagctcttgctcagagttgaggccttggtcgggtatgtgtgcgtgcgcggggggcggagggttacctcagctcctggggtggagggaggct

SEQ ID NO: 354181 - DNA, 3117 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaa

SEQ ID NO: 354182 - DNA, 3337 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctccggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagcctgggcaacagagcgagaccctgtctcttaaaaaaaaaagaa

SEQ ID NO: 354183 - DNA, 935 bp, Homo sapiens
ccctgagctgcctgcctcacgcccatgcattgaaccctaatgagatccagcgggccctggtgcagtgcaaggaacaggtatttctacgggcaatctgggaacctcttctggggcatctgggcagggaggttgggcatgggaaagctaagggcccagctcttgattcccgtatcctggagtttacagatgattgttggtcctctcatggcaacattttacccattaatgtgctttcacacccatctttcctttaccttacaactcaaaggttaggtttatttctattttacagataaggaaatggaggcctacggtttagggaccaagatgatcactcaggatagaaaacttagggaaggcctcatacatctaagacttgaatgggagggggctgttaaattagtttggaactgggactataacctgggtcttgactcattttggtcagtatttactcagtgtgtgaagcactcactgctctgataatggactctaagcattgacactgacctctgatgattccctgggaatgagacagctctgagggagacattggaatctcatctaacaccttccatgtggtaaaggcctttcccccttaacactctgtgcccctctcttccaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtt

SEQ ID NO: 354184 - DNA, 144 bp, Homo sapiens
gatgggggtccccaggacggcctaagaagaagcacacaggtaggatagcctgtgggctagcatagagggaaggataatcctgaaggttggagtcttaacatctgggactcctgacttctgagactgacttctcttgggggttag

SEQ ID NO: 354185 - DNA, 5844 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354186 - DNA, 6235 bp, Homo sapiens
ccttgagtggtaactttatcttagtccaggtgattccagttgcagcagtagctaggtgccctgcgataactctctccccttgagggtttccagtgtgggaagttgtcatttaggcgcgccaaaagtggtctggcctctcgtgcttcttgagatcccttccgggctctggtctatcttgtctccttagctgggggcctacagtcatctagagtaaaagggatggttaaaaaaaaaaaaaaaaggcaatcggagacaagaatgccagaggagagacattaaccatgtaatttgaatttaaaatgctcatggaatatgggaaattcagtgctgagccatgtgagcagggttacttgctagggtcctggaacgcacctgtctggccaggagtttcttaagatatctctggtatcttctgttctagaccttaggtgtagccggctgtgggctggggattatccagctcccctttcccatatggagccttaagggttagtgtatcctgatagggggatccctaggactttcatccaggtctcttctttctttcatagtgaagatgaggcccaggatgttgtactggcatgagtgccaagagaccatggcccttttcatttcctattctctttcccctgatcccaaccattgtttgcaaagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354187 - DNA, 5480 bp, Homo sapiens
gttcgatcgagctcgtgtaccgtctgagcagctgggaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354188 - DNA, 6493 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggtgagaggacatccctttctgtgctcctacctgcagttgtgccagtggctcttcagaggacccttcctctagctcttcatttgtttactgtggggtcaggtgacaggttggggtaaagggtgaagaggatacaccgtaccatgtgcccaccctatctatctatctcccaggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354189 - DNA, 5820 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354190 - DNA, 6967 bp, Homo sapiens
  misc_feature (6967)..(6967): n is a, c, g, or t
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccagggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggccttgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactctaaaaaaaaaaaaaaaaaaaaaaaaaaaaaaaaaaaaaaaaaaaagaagagagagagagaagaaaaaaaaaaaaacacgaaaaaagagaagcaaacaaggaagagagggggggggcgcgccgccaagaaatgatcctcccccggggggggcgcccacagagacgggcgcccgcaccacacacgttttgggggaagaaggaggggcgcgccccacaaagaggggggggttttttaaagaaagaggggccggcgggcgggggcgactaatatataacaaaccggcaggccctgcgtggaggacaaaagcccggcggggcgcccaagtaagtcgctgctgaagaaaaaggaccacacccccctaacttttttgtggggggggcgggcggagcgaggatatagtgcgtgggacaacccctacccagcgggcgagatataattttggatgccaccccacacggggacgagcaaataataaccttccgcgacggtgagagtagatgtgggtgcttacaccaacgctctcagattattagtccgaacgccggtgtaggcaaacacgctgctgccccctcggcggaacagtattctttggcgacgcaaacaattcttcttaccgccgcgcgcgccggagcttgctattaatagn

SEQ ID NO: 354191 - DNA, 6064 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctccggttcccggcccccaagtcgcaactggaacagcgagacacctggggatgaggagcttggatttgaagcagcagttgctgccttgggcatgaagacaacagtgagcgaggcagaacatcccctcttatgtgaaggcacacgtcgggagaagggtgacctggcattagcactaatgatcacttacaaggacgaccaggccaagcttaagaagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctgagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggacaacctgatgttggagaaggcctgcatggcagtggaagaggcagctaagggtgggggcgtgtaccctgaagtgttgtttgaggttgctcaccagtggttctggctatatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacaacttctcccgctcccccccctacactgatgatgtcaaatggttgctggggctggcagcaaagctgggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactcta

SEQ ID NO: 354192 - DNA, 3463 bp, Homo sapiens
cactctgttccttcatctccgaggccgagagcctctgccagaactggcggggatggcgcaaacagtcagcggggcccaattcccccactggcggcggtggcggaggtggcagtggcggtaccagaatgcgagatggactggtgatcccattggtggagctgtcagcaaagcaggtggcatttcatatcccatttgaagtggtggagaaagtttacccaccagtgcctgagcagctacagctccgaattgctttttggagcttccctgagaatgaagaggacattcggctgtattcgtgcctggccaatggcagtgcggatgagtttcagcgaggggatcagctcttccgcatgcgggctgtgaaggacccattgcagatagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccggaccccacagcagggccctcagcatcggaccagagtacttggtatctggatgaatcgacactcactgacaacatcaaaaagacactgcacaagttctgtggcccctcccctgtggtcttcagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtactgtttgcctgtgctgaggccctgcatgcgcatggctatagcagtgaggcctcccgtctcactgtggagcttgcccaggatctgctagccaacccacccgacctcaaggtagagccgccccctgccaagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctccggttcccggcccccaagtcgcaactggaacagcgagacacctggggatgaggagcttggatttgaagcagcagttgctgccttgggtgagtcttgagcatatcaacgagctaagcctggttcaggtcttgaaggacatgagacctgtgccttgttgtgaagggctgtatggtaatgggaaggtcaggatgacatgtgtgagccaactagtgcctgtaagacaggaattgagggcaaaaatgtgtgctatatggctgggcgtggtggcccatgcttgtaatcgcagcgctttgggaggctgaagcaggaggattgtttgagctcaggagttcatgaccagcctgggcaacctagcaagacctcatctctacttaaaaaaa

SEQ ID NO: 354193 - DNA, 479 bp, Homo sapiens
gagccttcatctccttgtttgcagagacataccatgattttagtcctcgggaaacgggaggtgctgagcactggtgttagcagtgatttacgagtcctttttctgagaggctttcatccttccttcccctaaataacacccacttttcaaaattctccagtgtttcagtgatgcttatggggctgggtcaagaagtactttcctgtatcctttccccatgcctctctttggggtgtacacctactccatgcccatcctttcccagtagcccctcagcagcctcctgccccttgttcccacaggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcgg

SEQ ID NO: 354194 - DNA, 176 bp, Homo sapiens
tcaactccattttcttctctcaatctcaactaacgctgagatccctgattcaaaccaccatcatacagcaagaatctctgaactggccttcttccaatcacttttgttctccacaatatgttgcatgcaacctgagttacattaaagatgcttaaagctctgcaatggcttctcat

SEQ ID NO: 354195 - DNA, 4215 bp, Homo sapiens
cttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacaagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagcgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatttttcactcccaacagctgtttttattttacctctttggcctaaagttttcataatttcaaatttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggagggccgtattaggaa

SEQ ID NO: 354196 - DNA, 4074 bp, Homo sapiens
cttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacaagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagcgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatttttcactcccaacagctgtttttattttacctctttggcctaaagttttcataatttcaaatttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggagggccgtattaggaa

SEQ ID NO: 354197 - DNA, 2144 bp, Homo sapiens
gctgtcgctactactactaaattaacaacccgtcgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagcgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatttttcactcccaacagctgtttttattttacctctttggcctaaagttttcataatttcaaatttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggagggccgtattaggaa

SEQ ID NO: 354198 - DNA, 3310 bp, Homo sapiens
cttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacaagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagcgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcgccatcggaaacttcgccatcggatacttcgccatcggaaacttcgccatcgg

SEQ ID NO: 354199 - DNA, 4156 bp, Homo sapiens
cttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacaagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctatagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatttttcactcccaacagctgtttttattttacctctttggcctaaagttttcataatttcaaatttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggagggccgtattaggaa

SEQ ID NO: 354200 - DNA, 569 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaa

SEQ ID NO: 354201 - DNA, 711 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaacaaaacacaaaaccctgcggggaatcataagcgctgcaggccggcaaaaaagcgctccataaaaagtcgccatgggcaaaagcgctgtcctgtgaacacagttactgttacacaggggcaaactggcgggccaccca

SEQ ID NO: 354202 - DNA, 1257 bp, Homo sapiens
  misc_feature (635)..(635): n is a, c, g, or t
  misc_feature (1046)..(1046): n is a, c, g, or t
  misc_feature (1257)..(1257): n is a, c, g, or t
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaaactcgagactagtctctgggggtgagaagccttgagcagcaaagtctctgggganaccctgtacgagggcggtgcgggaagtccggcacgggaaccagggcaagcgccgaggtccctggaaacggtggagttgcaaatcagtttgaaaaattttgatccccaaaagggacaagcgcttctccgggcaccgtcaggctataagtccattccacggcctaagttctctcggtgtgcgtccctgggggacccagcagcctgttggacagggcaagggcgcggggaattccccccacatgtggacttcgagggggctaaaaaattcctaggatattaatgtgggtcagagtgtggccgagtattgtaggcggttgggccacaagtcttgttaagagaatcccagagactctgtcgcggggtaaaaggggggagagtctctccgggtggccaccacaggaaaatggttgcncccgcggggaggggaggtcccccaaagtacccaaaaagagtatgtggtcatacatgtcgccgcaaataacacaaggttgttataaacacagcaattgtgttgtcaaaagaaaggggcttataataggacgcccatggtgttttttaaacagtgcgaggagctagagggctgacatactgacttattcttttcctcatctatcatttaaggn

SEQ ID NO: 354203 - DNA, 215 bp, Homo sapiens
gcggccgcctactactactactactactgctcgaattcaagcttctaacgatgtacggggacatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaa

SEQ ID NO: 354204 - DNA, 613 bp, Homo sapiens
ttttaaaaaaaaccccccacttacttatttgtagagatgggagtctcactatgttgcccagggtagtcctggtctcaagcaatcctcccaccttggcttcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354205 - DNA, 1023 bp, Homo sapiens
gcaggctttaaaaagcagcagaagcaagcgacgtgtctagccagacccgtcaagcaccagtcacttacctaacgtgagcagtcccaagagccgagcatatatgtgtaagtctggcaggactaatccccttcgtgctccaccactggatcagtgctgatgacgaaataacttatattcccatatatagcttgtagctcagatggcttatggagccagtttcctatctttcttgggtgggatcagatggggtttgtgctctaccagaaggtagtccagccaaaccagactaccttaatgtagctagcagtgcagctcctctgtgtgcttttcatggtttgcctgtcctgtatttctgaaagacttagtgaagccatagtcacagataactaagtgggtatgggagtacgcattccaccttgaactttgttctcggtaccacattatcccaactggtttaaagccctgaggatagtagtcactttatgggccacttttaactactaaagtgattatctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaa

SEQ ID NO: 354206 - DNA, 578 bp, Homo sapiens
  misc_feature (43)..(43): n is a, c, g, or t
  misc_feature (58)..(58): n is a, c, g, or t
  misc_feature (64)..(64): n is a, c, g, or t
ctgctgccccttacgcgcctgctgccccttacgcgcctgctgncccttacgcgctgcnggcccntactctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaa

SEQ ID NO: 354207 - DNA, 3307 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354208 - DNA, 3201 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354209 - DNA, 689 bp, Homo sapiens
gtggaggccgccgaggtcggggtaccgagggacgcagggaggccagcgcttcctcccgggcattcgagcggggcctcgtccttcgggagaacacattctccggagccctcttcgaacgtttattagtcggttcagggcaacttgaaggccaaatgtttggcccacaggccaataaatagtacgagagccaatcggcttaagggtttattccggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaa

SEQ ID NO: 354210 - DNA, 852 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaaaaaaaaaaaaaaaaaaaaaaaaaaaaaaaaaaaaaaaaaaacaaaaaaaatgcccgtgggctcagaagtgagatttgcattattcttctgttggattcctgatgaaaaaaggactttcactgtataagtggatggactgaaccaattagaattgatcccagtgaaatttttatattggctaccaatgggtacccaggagtcgctgaaacctcttttaaatttagaggggcaggctttacattaaggccttttttttaggatttggcttccct

SEQ ID NO: 354211 - DNA, 812 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaaaaaaaaaaaaaaaaaaaaaaaaaaacaaaaaaaaacactgcggggggcttttttgtgtgcgggggggggaaccaaaaggttttagtaagggcacaggtgttataaatgtttttcttgagaacaccatttttttttacagaaggggggataacatggcggcgcccccaaaaaggggggcgaaaaaattcggcaagacccgggtttccgctaatgtttcgttgtgcaaaaagat

SEQ ID NO: 354212 - DNA, 1081 bp, Homo sapiens
  misc_feature (625)..(625): n is a, c, g, or t
  misc_feature (637)..(637): n is a, c, g, or t
  misc_feature (1081)..(1081): n is a, c, g, or t
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaaaaaaaaaaaaaaaaaaaaaaaaaaaaaaaaaaaaaaaaaacaaanaaaaaaaaaaanaaccaaataaaaagaaaaaaaaaaggggggggggcccactataaaaattaaacgcccgcgagaggggacagcaaattcaaatcccccacgcccattgtgtctgaagcagaaaaaggcgacgaccaccaaagcgaggcagcacttaaaaaaaagacccagcggggagcgaccagtcacaaaaaaaagccggctgcagcgcagaaaaaacacccacgaggcggccaacatattgtgcggagaggcacaccaccctacccgcggcggaggggcacaacaaagtgctgcagacacacacccccagcggcaacatcaacactgccgccgggaacacacacccgcgcggggtccagtcgggacacacaccacagcgaactaagcagcgcggtgacgcgcaagaatagcggctcgcggcgagacggaatcgaacaaaaaacaaaacgacgn

SEQ ID NO: 354213 - DNA, 991 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaaaaaaaaaaaaaaaaaaaaaaaaaaaaaaaatggggggggcccccaaaaaattaacccccgggggggcgccccatttgcgcgtcccccccgtttttttggaaaaggggggcccccaaaggggggggataaaaaaaggggggccggggcgcgcggggtataaaaccaagcggctcggaggggggagaaacggtgccacggggagcatttttgggagagagcagagcccctactatcttcgtggggcggggcgaccacatatgggggcaaaacttccctaaggagaagtattaaaaacggcctagaggggcaaattatcacatttcacgggttatagtgggtgtgcaccaacgcgggatatgtgcttcggggataaaactttccgcaccgggagtattattcgaacatttttcg

SEQ ID NO: 354214 - DNA, 2534 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatcccggggagaaacaattcccttatcattagaaggaacccactgacttcgaagtggccgggttctttcacccggggcggaaattctcatggtggtcctgtcaacacacgaccacttgttaaacgcaggataactcggagcatgcacacggtc

SEQ ID NO: 354215 - DNA, 1159 bp, Homo sapiens
  misc_feature (589)..(589): n is a, c, g, or t
  misc_feature (601)..(601): n is a, c, g, or t
  misc_feature (1158)..(1159): n is a, c, g, or t
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaaaaaacaaanaaaaaaaaaaanaacccgggggtcttatagtgggggggggggaaaaaaggggttaggaaggggctgggtaaaggggtgttcctgtggccccgtttttggtgtaaaaggggggaaattggggggggcccccaaaggggggggggggaaaaatgaaaaaggcgggggttacccgttcttttatggatcgccgcaaaccgcccgagaaaaaacaccgccaaaaaaaagcggacaacgggaaacaaaagaaaacaaggaaacctataagcgagagaaacagggagagtacgacagagagacacccacaaaaagaggaagctaagcacgaagagacaaaaaagtcaaacgaagatgagacacagaaacaaaaaaaaagcgcatcagcaaaacagcaggatcactaatcgagacaagataaaacaagcaagaaggacagagaaagagtgaaacctagtcagtcgaaccatacagagtacttagcgaaagaggaagagacagaactggacattacatcaaacataggcagaacgaaataggaagatagctcactccccccactctactcctgcctnn

SEQ ID NO: 354216 - DNA, 1121 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaccacaaaacaaaaaaaacaaaacactgttgttgggcgcgcgccctgggcccccggaaaagatttcgagaacaccatgcggcttggggccgcgcgcgcggccccagtgggtaagtggggaaccggggccacaaaaaggggaccaggggaaacacccgcgggcaggaactggggcctgggttctccccacaataaaaaagggcccggggggaacaacaggaggttgttttcaaccacaaaatccagagagggggggggtacgaggaggagacaaaaaggcggggccgctctactacaacagggggggctccaaaaggagagcgaccgagcaatcaaaaatataccccgcgccgtgagggagaagaaagaaagaaagaaatacaaacaaacaaaagacagcgaaaagagaaagacgagacacgaagaaaacaaagaaaaagaaacaacagacacagcaagagaaagcagacaacgaaagaaaaaagacaacgagaaagcgagaaaaaaaagaagcaaaacagacaacaaaaaacaagaaaaaaacaaat

SEQ ID NO: 354217 - DNA, 1067 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaacttcagattagtctctctttctcccgaagggaaagagggccaggggaacagcaggggggcccgggccccagttgctcgtgaaaaaagcgaggaggctaaaaagggggggaacccccgtgctcggagaaaagggcctaagaactcgggccttgggacgggacatcagcccaaaaagagacctcaacccgtttggcggcaaaggccccggaataaatcagcgtcgagcggaaagagccagcctctataaggggctgaaggtgcctcgtggaataaccacgtcaccaggcccggaccggcaaagagctacacagcgtgtaaagggggccccaaaagctaaggccagaagacaaggaggaaaaaggcgagcatgggggcccgggcgaaaaaacaggggggtgcaaagggggcactcccagaagagaccccggcctcggagcagagataaccccgtacacctggggggacacagaagcgcaggtgggcgaag

SEQ ID NO: 354218 - DNA, 1020 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaacaacaaaaaaaaaaacaaaaaaaaacaaacaaaagaaaacaaaagagacaacaaagagaacaaaaaaacagagaaaaagaaaaacacaacaacaagaagaatcagacacacacacacaagaagaaaacagagagacccagcccgacagtcaactagggagagagaatccgcgacgagagacgacagagtacaagagggcacacacagaggtgagaaaaaaagaaagggagggaggacaataaacacaaagagagaaaacacaaacagggagaacactagagaggagaacaaaagaaagggagaaagaaacgagaaacaagcacacgaggcgaacccgcagccgcgaaaaacgaggagagcgtgagcaggcaacagaatagcgcgggaaagaagagagacgggaggcgccaaaaggggcgaggagagaagaagaaaggggg

SEQ ID NO: 354219 - DNA, 3305 bp, Homo sapiens
  misc_feature (421)..(421): n is a, c, g, or t
  misc_feature (423)..(423): n is a, c, g, or t
  misc_feature (427)..(427): n is a, c, g, or t
  misc_feature (433)..(433): n is a, c, g, or t
  misc_feature (440)..(440): n is a, c, g, or t
  misc_feature (442)..(442): n is a, c, g, or t
  misc_feature (444)..(444): n is a, c, g, or t
  misc_feature (446)..(447): n is a, c, g, or t
  misc_feature (450)..(450): n is a, c, g, or t
  misc_feature (457)..(457): n is a, c, g, or t
  misc_feature (459)..(459): n is a, c, g, or t
  misc_feature (461)..(461): n is a, c, g, or t
  misc_feature (465)..(465): n is a, c, g, or t
  misc_feature (468)..(468): n is a, c, g, or t
  misc_feature (472)..(473): n is a, c, g, or t
  misc_feature (476)..(476): n is a, c, g, or t
  misc_feature (479)..(479): n is a, c, g, or t
  misc_feature (484)..(484): n is a, c, g, or t
  misc_feature (488)..(489): n is a, c, g, or t
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtatgctntngggngatatncctgagncncntnntanggttgtnanantagncantgtnnctnttntggcnctanncaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354220 - DNA, 3449 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggtgagtatttcaactctatcgtaccttctgttgttggggtggcctccctcacatttttatctgatgcaagggagtttcctcacatgaaagtatttttgtgatcgccaccaacaccagaaataaacttcttattttattccaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354221 - DNA, 555 bp, Homo sapiens
  misc_feature (498)..(498): n is a, c, g, or t
  misc_feature (500)..(500): n is a, c, g, or t
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaagtagntnagagagccttgccgctagccccctctcccccttcccgatgtatatctgcgtcccc

SEQ ID NO: 354222 - DNA, 3406 bp, Homo sapiens
ttagtcacactgggaaagctgaacaattgtgttttcgtcacaggagttctttgtaatgcttgtacagttgatgtcgatgctcactgcttctgctttttctttctttttattttaatatctgaaggttctggtaacctgtggtgtatttttattttcctgtgactgtttttgttttgtttttttcctttttcctcccctttgaccctattcatgtctctacccacttcgtgggcagcgctgcccacgaagtgtgtaagggtccagctgatcaagaatggcaagaaaatcacagcctttgtacccaatgacggttgcttgaactttattgaggtgagtatttcaactctatcgtaccttctgttgttggggtggcctccctcacatttttatctgatgcaagggagtttcctcacatgaaagtatttttgtgatcgccaccaacaccagaaataaacttcttattttattccaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354223 - DNA, 674 bp, Homo sapiens
  misc_feature (43)..(43): n is a, c, g, or t
  misc_feature (58)..(58): n is a, c, g, or t
  misc_feature (64)..(64): n is a, c, g, or t
ctgctgccccttacgcgcctgctgccccttacgcgcctgctgncccttacgcgctgcnggcccntactctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagttctagctctgtcacccaggctggtgtgcagtagcgcaagactccctgcaaccttagcctcccaggttcaagcatttctcctgcctcagcctcccagaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaa

SEQ ID NO: 354224 - DNA, 478 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgcgttggggatatccggggcccccttaagggtgtaaggggccacgttgctgcttgggcct

SEQ ID NO: 354225 - DNA, 340 bp, Homo sapiens
  misc_feature (43)..(43): n is a, c, g, or t
  misc_feature (58)..(58): n is a, c, g, or t
  misc_feature (64)..(64): n is a, c, g, or t
ctgctgccccttacgcgcctgctgccccttacgcgcctgctgncccttacgcgctgcnggcccntactctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtgagctggagattggatcacagccgaaggagtaaaggtgctgcaatgatgttagctgtggccagccaatggtcctgcggt

SEQ ID NO: 354226 - DNA, 532 bp, Homo sapiens
  misc_feature (43)..(43): n is a, c, g, or t
  misc_feature (58)..(58): n is a, c, g, or t
  misc_feature (64)..(64): n is a, c, g, or t
  misc_feature (305)..(305): n is a, c, g, or t
  misc_feature (321)..(321): n is a, c, g, or t
  misc_feature (326)..(326): n is a, c, g, or t
  misc_feature (345)..(345): n is a, c, g, or t
ctgctgccccttacgcgcctgctgccccttacgcgcctgctgncccttacgcgctgcnggcccntactctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagcaacagccaaatctgcattaggagtgtgtaggntcagctgatcaagatngcagnaaatacagcctttgtaccnatgacgtttgcttgactttttgaggaaataatgaggtctggtgctggattggcgcaaggcatgctgttggtatattccagggcgcttagggtgcaagagcaattttctttttgcctaccaaggcagaggaacccaggccatattttatggtaaacctttgtatatttcattcaaaaaaaaaaccctg

SEQ ID NO: 354227 - DNA, 465 bp, Homo sapiens
  misc_feature (238)..(238): n is a, c, g, or t
  misc_feature (254)..(254): n is a, c, g, or t
  misc_feature (259)..(259): n is a, c, g, or t
  misc_feature (278)..(278): n is a, c, g, or t
gagctcgcgcgcctgcaggtgcgccgacagatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagcaacagccaaatctgcattaggagtgtgtaggntcagctgatcaagatngcagnaaatacagcctttgtaccnatgacgtttgcttgactttttgaggaaataatgaggtctggtgctggattggcgcaaggcatgctgttggtatattccagggcgcttagggtgcaagagcaattttctttttgcctaccaaggcagaggaacccaggccatattttatggtaaacctttgtatatttcattcaaaaaaaaaaccctg

SEQ ID NO: 354228 - DNA, 3254 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggcatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354229 - DNA, 3142 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354230 - DNA, 3499 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggattacaggcgtgagccaccgcgcccggcccatagtgtatatgcatatcttgagcctgtgtttaccttggttaaaaaattatttttcatttatttttccctatttggtaggcattaaatgatatttgttcacattaattccaaagtaatttctttaaagaggagatggaatttcgctcttgtggcccaggctatagtgcaatgtcgcgatctctgctcacggcaaacctccgcctcccagatacaagcaataggcctctagcctcctgaatagctgggattcacaggcatgggtggaacatagcctgtagaccagctacatgggagagctgagacaggagaatgacttcgaaaccggcaggcggaggtgccagcgagccgagttcacgccaacatgcataacagtcagagcgaagagcacagaatcgtctcacaaaaaaagaaaaacaaaaacaactcacgccggagcgcatacacagggcccataaacaaaaaccaggacacgccacaagaaagcaatagaaatgcaagcggaaaaacacagacagccacacaacacgaatacgaacatgaacacccaaagaacagaacgagcaaaaaaggaagaataagacgcgccagacaacaacaaccgatccgagccaaagcaaacgcgagacactcaagaagagagacgagaagagagaaaaaatacgagagaaacacacgaaagacaagatagccaacaaga

SEQ ID NO: 354231 - DNA, 824 bp, Homo sapiens
  misc_feature (664)..(664): n is a, c, g, or t
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaaaaaaaaaaaaaaaaaaaaaaaaaaatttttggggggcttgggcctgagaaaaaagttttcaaaacctatgggtggggggggggnccaagtagagaacgagacaaacagtgcaaaaaaacgaacccaagagaaaaccgaggtcgagagacagacgcagagaatatacaaccaataaaaaaagagccggggagaccacgaggtttaggacaatccaaagagaatagagagccaagagggacaagca

SEQ ID NO: 354232 - DNA, 1077 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaaaaaaaaaaaaaaaaaaaaaaaaaaacttgggggttttttttgggggggggaaaaagagggtttgaagtgggcatgggtcatggtggtttccggacccgtttttttgtcaagggggaaaaattgggagggccccaataagggaggcggggtataaattgcgaacaaaccgccgggttaaccctggtagtagttgttcgggcagcgagaaattcaggaaacaagaagacggaaccgaagacggaggacagaacgagacggcgaagcaaagcaaggacacacgacacccacgaccgaaagaaaacagcaacgcagaacagcaagaaaagacgcggaacaggggacacacagaacagaaagagaacacatggggcaacaaaaagaagacaacacaagccgaacgacagcacgacacaggccaacaagaacagacgcaacaaaaggcaagacgaagcaagacgagaagagcaaaacaagaacacaactaagagcgaaacagg

SEQ ID NO: 354233 - DNA, 1776 bp, Homo sapiens
  misc_feature (1775)..(1775): n is a, c, g, or t
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaattagccttttgatcaaaagctagatttacatgttaggatcttgggaaaaaatggttggtgccactttcgtagggacaagagcagaaccttaaatggacagaagaaccaggtgggcttctactgctattcagcttagctgcattctctcttggcattgtgtcaagacactgatcagtgggctctcaactggtacattcagctcggctgccgtacaggtctgatggcacggctacaaagacggaaaagggacagatattataaagaatatctcagggagcgtcgggccatgaaagttacattgagacagaaagagagaacaggaaaagacagaagagcacatcggaggatctcctctcttttcng

SEQ ID NO: 354234 - DNA, 880 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaaaaaaaaaaaacacaaaaaaaaaaaaaaaaaaaaaagggggggggggtaaaaatttccccgggggggccacaattagggtaaccccgtttttttgttaaaaggggggctacattgaggggggcatattataataaaaggacgagggcgggctaaaacaagggggcggggaaaacggtagtggggaatttgggggagaacccttctggggggggcgccaatgggcaacatccgagaaataagacggggaaaataaacttaagctgttatgggtaacaggttagtggggaaaatggtgcgcttcttggacata

SEQ ID NO: 354235 - DNA, 862 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaaggtaccaattggcccggagccgtttacacatacctggccgggcgtttaacgcgctcgggacggggaaacccggggtacccagttaatgcctgtagagatcccctttgccaggggtaaatcaagacccgcgattgcttcaagagtcacgcatgtacgtgcaatccgaattaggaacgccatagtagcacatttacacaggacgagaccctacaaagcccggcgtgccgccaccatgatcacggacatagggtaacaatggtgaagtggattgattattctctgtgacagcgatg

SEQ ID NO: 354236 - DNA, 3263 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354237 - DNA, 3357 bp, Homo sapiens
ttctgagagcgattcttgttggcgcggggtcgcaggtacgtatacctgaacatgggtcattatcttgtcgtctctacgcacgcatgcgtggcccgatgacgtatgtgctaggagtcctcgaccattagactgcgtcaccgaaggtcacagcaatcagtcgctcgaagcaacatccagagtggatgtatctagaagagtcataaagcaaggactctattcagggagagagtccatagacgagctcgactattcaagagttgagctgcctctcgtcattgaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaatgtttgtatcttactgtcccctgttctcaccatgaagatcatgttcattaccaccaccacccccccttattttttttatcctaaaccagcaaacgcaggacctgtaccaattttaggagacaataagacagggttgtttcaggattctctagagttaataacatttgtaacctggcacagtttccctcatcctgtggaataagaaaatgagatagatctggaataaatgtgcagtattgtagtattactttaagaactttaagggaacttcaaaaactcactgaaattctagtgagatactttcttttttattcttggtattttccatatcgggtgcaacacttcagttaccaaatttcattgcacatagattatcttaggtacccttggaaatgcacattcttgtatccatcttacaggggcccaagatgataaatagtaaactcaaaattgctccccactctgtttattatttaaaggtgtcaggatctgtgttgtaatgtgtctacattaatgtgtttaggagaatacaggcattggatcatttagttgatggaagtatatgccaggcaagggagataaggtatacgacaagactgatgttttcagtacttctcatgaggttgtcagagaccttcatgtcttcaaagactagtcagcaaatgaagtggtttagtgtagagacaagattggttgtgttttgataatttaagctaggtattgagtacatgtggattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgctccagcaacactggtctcagttggtcatcctcaaacttgggttccatatccagcctcaggacctctgttcctgttactatggttccttgcatgtcgcctgctcttactaaagagctcgtgtgttttccagcacacttcggtttatctcttgatgatgatgctagtctctccctccgcaagggcggaaaggctgcctgttggtttgtaccagtgtttcctaacgtgtagctgcagtcagtatttggctaagctgttcccaggggctcaacagatgctttcggatgagccttaactgacccaatcctttgtgatgcgggagagattgctaggcctcgctcacctggccagaaccagggaaagaggccgcggttgcagcgcgattccaggccctgggcgtcaggcgcggggtgggcagctctccccgggcggtggggcccttgtgaccgcgaggcggggcgcaccaggaagggagtgggacagcgcgggcgcccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggcgcctcagatccagaagctgctgagcctgatcttagtgccttctcctttctctgtgtggccccccagcccctttccccactgccttgtgtccaaggccctttccttcatgtatccatggaggagagacaaaaatacacatcaataaaataagatagggaatccataaatagacattcagaagtatggccaacggatttatcttaaaaccaatggaggaagaagagtttcaataaatgttgtggacttccatttgtcaaagaccaaaacaaaggaaccccaaccttacatgtaatacaaacttaactcaaaatggatcatatatctaaatgtaaaatggaaagctataaaactgaaaacagactatctttacaacctaggcgtaggtatagtttttagacattacaccaaaagcacatgccgtaaaagaaaaaatagataaattggtggatttcattaaaattaaaaaactttttctctctgaaaaatcctgttaagctgggcgctgtggttcatgcctgtaatcccagcactttgggaggctgagttgggaagaaattaatagcttgaggccaggagttcaagatcatcctgggcagcaaagtcatacactcttgagggaagagagagaccttctcatattgttttatattgttttatactcagtacctgttttaagaaaaaaacaaggaagtgaaatcaaagacaggcagcccggcaccaggcctgaaaccagccctgggcctgcctggcctaaacctagtagttaaaaatcaacttacgacttagaacctgatgttatccgtagattccaagcattgtataaaaaaattgtgaaactccctgttgtgttctgtaccagtgcatgaaacccctgtcacatatcccctagattgctcaatcaatcacgaccctttcatgtgaaatctttagtgttgtgagcccttaaaagggacagaaattgtgcacttgaggagctcagattttaaggctgtagcttgccgatgctcccagctgaataaagcccttccttctacaa

SEQ ID NO: 354238 - DNA, 567 bp, Homo sapiens
  misc_feature (421)..(421): n is a, c, g, or t
  misc_feature (423)..(423): n is a, c, g, or t
  misc_feature (427)..(427): n is a, c, g, or t
  misc_feature (433)..(433): n is a, c, g, or t
  misc_feature (440)..(440): n is a, c, g, or t
  misc_feature (442)..(442): n is a, c, g, or t
  misc_feature (444)..(444): n is a, c, g, or t
  misc_feature (446)..(447): n is a, c, g, or t
  misc_feature (450)..(450): n is a, c, g, or t
  misc_feature (457)..(457): n is a, c, g, or t
  misc_feature (459)..(459): n is a, c, g, or t
  misc_feature (461)..(461): n is a, c, g, or t
  misc_feature (465)..(465): n is a, c, g, or t
  misc_feature (468)..(468): n is a, c, g, or t
  misc_feature (472)..(473): n is a, c, g, or t
  misc_feature (476)..(476): n is a, c, g, or t
  misc_feature (479)..(479): n is a, c, g, or t
  misc_feature (484)..(484): n is a, c, g, or t
  misc_feature (488)..(489): n is a, c, g, or t
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtatgctntngggngatatncctgagncncntnntanggttgtnanantagncantgtnnctnttntggcnctanncaggcaagaaggaaagaccaagatcataaatattaatggtgaaaacactgtagtaataaattttcatatgccaaaaaa

SEQ ID NO: 354239 - DNA, 711 bp, Homo sapiens
ccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtataagaaagctcatttgggcacagccctaaaggccaacccttttggaggtgcttctcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggtgagtatttcaactctatcgtaccttctgttgttggggtggcctccctcacatttttatctgatgcaagggagtttcctcacatgaaagtatttttgtgatcgccaccaacaccagaaataaacttcttattttattccaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaaacactgtagtaataaattttcatatgccaaaaaa

SEQ ID NO: 354240 - DNA, 879 bp, Homo sapiens
gaaggtgatggtttcttgatttattaacaaataattttatatgtttttataatttattataaaatttattttatgactaatctatagatgtttatagtattaatactagggatttttttctacattaagaaaagaaataaccaattattcaattatttccagtggtctttttgtgttctgtgtttccaggcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggtatgtaataaaataaatgaatatgtttgtcacagtatctttaatgcagattgagtatatatatactactatacacaattgtgtaggactgctacagtggctgggaatcacatgtgattttctgatgttgcttctgggagttacagaaatatttgtaagtattattaatcttagggtcaaaagttaccgaaatatttaaagatgagtaaatgaaaatatctaatatagaagaatataaaaatgtattaaatcaatataaatgtcagatatataactataccattaaatgtggtggggaacggaatgtttttgactcagctaaatttttagagaaatcggtagag

SEQ ID NO: 354241 - DNA, 2136 bp, Homo sapiens
acataactccccatgtctgttgataaaaaagagaccctaaggaggattaaactgttctcatcctttcgttagggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354242 - DNA, 655 bp, Homo sapiens
tccttttctgggagatggtctccttctgttgcccaggctcagggcagcagtctcagctcactgcaacctccacctcctgggctgaagcgatccacctacctcagcctcccaaaatgctgggattacaggcgtaagccactgcactcggctatagcatcttttataaactggttttgtcataaaatttcctctaaactagtaggactattcccttcttgcacctttgttgtttagaaaatgttaatatgttaaccctatattaattttaggcattttctttgtataatcacttaagtaattgttttcttcctgttcttttttttaatgttaacataatgccatatgaaacaggttctatatcatatataacagaaccttgtagtaatattattgccctaatttataaggataactttgtcgtacctcttcagttggctgagaaaaaaattgtctaccatacgacaaataaggttttttgcacactgtatttctaatgaaggtttataaatttggaacttaattgcttttacagtattgacaatactgttcaaggaataattgggatactttttaaggctattattttaacaagatattaggaagtctgaaaagtgtataaaaactcttaacagttgctagaagtagaaatggacac

SEQ ID NO: 354243 - DNA, 2379 bp, Homo sapiens
gaaggtgatggtttcttgatttattaacaaataattttatatgtttttataatttattataaaatttattttatgactaatctatagatgtttatagtattaatactagggatttttttctacattaagaaaagaaataaccaattattcaattatttccagtggtctttttgtgttctgtgtttccaggcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354244 - DNA, 4153 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgattgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354245 - DNA, 4177 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgattgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354246 - DNA, 1574 bp, Homo sapiens
ccccgggctgcaggattcggcacgagcaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgattgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354247 - DNA, 1774 bp, Homo sapiens
tccttttctgggagatggtctccttctgttgcccaggctcagggcagcagtctcagctcactgcaacctccacctcctgggctgaagcgatccacctacctcagcctcccaaaatgctgggattacaggcacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354248 - DNA, 5200 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttctattgtctttgtgtttcataattagtttttataaaaacagtttacattaaacatcttggaattcaacaatagtgatctcactcaaattgacatttgcataatttgacatttatattcattcagttatgactacttgcccttttcttcatattagtaaatgttacactgtagtagttgtcaatgttaacaggcttcaacatagtatgtgtgcagatggacgatggatttaaagagcataccttatgattaaaccgaggttatagaaggtcaggggagagtgaaggagtcagtgacctatgtctgccatcttactggggaaaagagcaagtagcctgtcttcctttaagtaagtagcctgtaatggatgtactactttgccactggaataccccgggtctgtgccaagggactgaagaagtgtaagatggggagaactgtatgtcatggagtcctcttgacgttcccccagatacaagtaaagcacaggtggatttctctatttttgaatactacatcagatttagatgcacgactacctgttgacttgttttataattgctactgatttttttaatgtaggcaaagctttgttactttgaaatttatttaataaaagtatttgtgacataaacctgaattgttaatataggagcttattaagctactgccattagttatcgaaaaatgtgataagtaatgaagaaagtaaggaagaaaatgactttgaacattttgactttttgtgctttgttttggtgtcttccatatcctgctgcatcttatatgtcaaaatgaacatttcagtggtagctgtccaaatacataaaaactaaaattcttttgttagcaagtccttatttttattgttgttaacatgcaagtgataaactgataatttgaaacatttttcttactctggtgactttcttttagctgctagcacacttcagcatttgaaccataacagttgtgataaactgatcgtttgaaacgttt

SEQ ID NO: 354249 - DNA, 1578 bp, Homo sapiens
ccccgggctgcaggattcggcacgagcaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354250 - DNA, 1580 bp, Homo sapiens
ccccgggctgcaggattcggcacgagcaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354251 - DNA, 1545 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccacaacttctaaggttaagcttaaccttagaagttgtggctttcacataggatgcttttgaggattaaataaagcatacgtacattttttgttaattttttattgaggtccaatgtacaaatgcaatactaattctgataggttttaacagtctatatacttttataggtaagattgctgtgagtaaccaaccccacgccaggggaaattgagtcacggaaaaattgcttttcaaattcttatttccagccccacttctaggtgtaagggggtcc

SEQ ID NO: 354252 - DNA, 416 bp, Homo sapiens
tctttggagaaatcttgtatgaaaaacttaacatttagtaagaaaggcttatgggtttttgtggtgactaaaaattctttatttatatttactaacttaatattgatgtcatttaaggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatggtaaattgaagtagtaacagtagaaaattatgaaaggagtttgataaaaggaaatctcttaatatgctagaaactcctcctgcttactggtaatatattattaaactacagggaaattgtcagattttttaatct

SEQ ID NO: 354253 - DNA, 640 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggtaaaaatgtttaagctgagtaaaacatggaacctattgca

SEQ ID NO: 354254 - DNA, 4206 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354255 - DNA, 4230 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354256 - DNA, 2275 bp, Homo sapiens
ctgccgtctgcatggggaaataagaaatgttcttgatctcaccaatcttcctcctcttggagtcactctctttaatcaccaaccaaacagcttcccaaactagaaactgcagaattatggtaagtgattctagctccacactgctttctgaaccctggcctagggcaggttcagaaaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggaactgattcatttggaagaaagattaggcaatgtcaatcgtggagcatcccaggggacaattgaaagatgtacatatccacataaatacaaaaaggtaacaactgattggttctcacagaggaaactgcactgcaaacaagatggggaagaagggactgaggaagacacagaggaaaaatgtactatctgtttgtctattttagaggaaggtgaagatgtgagacgtcttccatgtatgcaccttttccaccaagtgtgtgttgaccaatggttgattaccaataagaagtgccccatatgcagagtggacattgaggcccagctgccaagtgaaagttgacaccatgtttcagaactcttgccctccctctcattcccatccttcctggtactgcagtcaaccaaagatggcatgacttacctgcgcagatttggaagcattgaacttagagtgctggctctgctatatggtacaactaatgctagacctacagtttatgtatacagttgattttgatgtatttataaaagcttttttttctagatttgacatttttctgtatcattttactgtatttttgcatggttccttgtattgcatttctttgcacatattatgggcttgtgaccctaaacttgcaggcaaggttagctgctttagtaagtagaattttgtggtctttttgttttttacatagtaccaagccttgataattatgaattttttatccattactaacctttaatttaatcaatcatgtactttagtttaatgtataaagatcctctagaaaatgataatattgtgtattaagacattccttaattaggacaaaatggctgctgtatatttactatatggagttctgagttaaataccatccttaatactgggaacagaatacaacccatataaatcagatgcaggtggtagtcacatcaccagagtgatcagtataaattttcttggtgtatccttttcctttcaacacagtgcagataagagttgaatattgatatcatacatttagactgctgttctgattgcatttatctttttcctacatcatttagaattttatttccctgattcagtttttgctgctgtgaaacagctctgatgaacactaaatattaatttcaattagctagattgtacatacttgcagatttaacaaaattttagggaaattgaaaaagacatgtagaatttgttgtcttctgctaagcacgaaaagttaagatatctgcttacattgattttgtagacacattaagtcaagatttggaatttaagtcactggcaggtatctgtgcattcatagaacttataaaggtcccaggatcacttttaagggatttttattagtttaaaggtaaataaagtcagctgaatctacatgtctcttgttttatttctctctaaacttgaaaacagtaaatctgcagatactgtgaggcacaaattatactgtcaacctactgttgctatggttatatactcccacttcatacattaccaagagtcgatcactgatttaaaatttttaatttctatagttaagatttactgcataatatagaatataaagttaagttaacatactaacatttctcctttggaggaagttttaatctacttcaggatgcatattattatcaagatactttcatatacaggatagcctaattttatttgtttaaatatgcttaatatgccccagattgcaaatgcatccagtcagtaatatcactgtctgtatgtggaggacatgttcccatggatcatatgtgaagatgtcaataagcttgcattaagccacctgctttgtaagtggattgattaataaataacttatatttcta

SEQ ID NO: 354257 - DNA, 2706 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatgaacctactgtagtaccaaccacttctgcaagaatggaatcacaagctactagcgcttccattaacaattcaaatccatctacctctgagcaggcctctgatactgcttcagctgtcaccagtagccaaccttccacagtgtcagagacttcagctactcttacaagcaatagtaccactggcacttctataggagatgactcaaggagaactacatctagtgctgtaacggaaactggccctcctgcaatgccaaggttaccttcctgctgtccccagcactcaccatgtggagggtcgtcacagaaccaccatgcattaggacatcctcatacaagttgctttcagcagcatggtcaccattttcaacatcatcaccaccaccaccatactccccacccagctgtcccagtttctccttcctttagtgatcctgcttgccctgtggaaagacctccacaagtacaagcaccttgtggagcaaatagtagttctggtaccagctatcatgaacagcaggcattgccagtggacctgagcaacagtggtatcagaagtcatggaagtggcagttttcatggagcatctgcatttgacccctgctgccctgtttcttcctcccgagctgcaatctttggccatcaggccgctgctgctgccccaagtcaacctttatcatcaatagatggctatggatcaagcatggttgcgcagccccagccccagccccctccacagccctctctctcatcatgtcgacattacatgccacccccttatgcctctttgacaaggccacttcatcatcaagcttctgcctgcccgcattctcatggaaacccccctcctcagactcagcctccgcctcaagtggattatgttattcctcatcctgtacatgctttccattctcaaatatcttctcatgcaacatctcatcctgtggcacccccaccaccaactcacttagccagtacagctgcaccaatccctcagcatcttcctcctacacaccagccaatttcgcaccatattccagccacagcacctccagcacagagactgcatcctcatgaagtgatgcagaggatggaagttcaaaggaggaggatgatgcagcatccaacgcgggcacatgaacgccccccaccccatccacataggatgcacccaaactatggtcatgggcatcatattcatgtgcctcagactatgtcctcacatcctcgacaggctccagagaggtctgcctgggaactgggaattgaagctggagtgactgcagctacttatacacctggtgcattgcatcctcacttggcccattatcacgcacctcctcgacttcatcacttacaattaggagctcttcctttaatggttcctgatatggcaggctatcctcacatccgttacatttcatcaggattggatggaacatcattcagaggtcctttcaggggcaattttgaggtatgtaataaaataaatgaatatgtttgtcacagtatctttaatgcagattgagtatatatatactactatacacaattgtgtaggactgctacagtggctgggaatcacatgtgattttctgatgttgcttctgggagttacagaaatatttgtaagtattattaatcttagggtcaaaagttaccgaaatatttaaagatgagtaaatgaaaatatctaatatagaagaatataaaaatgtattaaatcaatataaatgtcagatatataactataccattaaatgtggtggggaacggaatgtttttgactcagctaaatttttagagaaatcggtagag

SEQ ID NO: 354258 - DNA, 991 bp, Homo sapiens
cgcaaaagccagcaggctggcccttcgtatgtgcagaattgtgttaaagaaaaccagggaatattaggactgaggcaacacctagggacaccaagtgatgaagataatgattcctcttttagtgattgtctttcttctccttcatctagtctgcattttggagattctgatactgtgacttcagatgaggataaagaagtctctgtaagacattcccagaccattttgaatgctaaaagtagaagccatagtgcacggtctcataagtggcctcggagctgagacagaatctgtatcgggattgttaatgaaaagaccctgtttacatggcagttcgttacggagacttccatgcagaaagagatttgtaaaaaataattcctcacagaggacacagaaacaaaaagagaggatattaatgcagaggaagaaacgagaagtgttagctcgaagaaaatatgccttgctacctagttctagtagttccagtgagaatgacctcagcagtgaatcctcttctagctcatcaactgaaggagaagaagatttgtttgtttctgccagtgaaaaccaccaaaacaatccagctgttccctcaggaagtattgatgaagatgttgtggtgatagaagcttcctccactccccaggttactgccaatgaagaaattaatgttacctcaactgacagtgaagtggagattgtaacagttggagaaagctatcggtctcgttcaacccttggacactccagatctcattggagccagggttccagttctcatgcaagtcggccacaggagccacggaaccgcagtaggatttctactgttatacagcccttgaggcagaatgcagcagaagttgtggaccttaccgttgatgaagatggtaaattgaagtagtaacagtagaaaattatgaaaggagtttgataaaaggaaatctcttaatatgctagaaactcctcctgcttactggtaatatattat

SEQ ID NO: 354259 - DNA, 332 bp, Homo sapiens
actattggaaagactcatgttttgttgtacagtcaagaacaagacaagatcaaatgtaattttcatttctaatctgggaaataagtccaagaagacataaatttaacagtgatgacttttataactaatacttgggcacacattttttattcttagaattgtgtaacagaagtttagttttattactcggagtatatatgatatactcttctctgtaagcatttcctcacatttaacatataattcatgagggaaatcaagtccttaaaatgtacccagtgttcctcataagtgggagttgaacaatgagaacacatggacacagagagggg

SEQ ID NO: 354260 - DNA, 1146 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354261 - DNA, 863 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccgtatccttcaacaaacaacacgggaaaatgttgaagaacaccctggctcttcctaaagcttgtcatctgtctcccacagttctctagatcttagcttcagggcactatcatttattttacagcacattttctgtgacaagtttccaaacctagcagtcggacaggatgagcaagtcaaaggaacttttaacccaggtgggttactgttaagcaactcagttatatcattactgcttggcgtacttcacttttaaactaagttggtaagacatttacttggtggctaccaaaaccaataaattattttttcagaaaaagaattttcatctatacaatagacttagatatggtacggtctgacaagatggttttgttccagctagctttattcatctctgtaaaggtgctaatcgtgagcaagctttaatataattattgactgaagaattaacacattttccaaagaggcaagaacttcacgaaagcagagtatttgtttgaagt

SEQ ID NO: 354262 - DNA, 804 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctgtatcctttattaaatggggtcagcatcaaaactttttcttaggaagtaaaaaattaagttgaaacttttcatcctgttacttgtttttggtaccatcttagctatgatttctgggtcagtggtacataaagtagttgcttaggtagtaatgttttgaaaatgtctgtaggtcactttgttcaaatgggaggttttaaccataaaaagatagcacttctgctcttttgttacttacaaatctgatcaagggaggggagaattgatttaactgaggcatacctccacagtaaccaacaggttcgaagccgtaaaacaacctgaatgcaatggtaattcagcagaatttgggcataagttttggaatgggttcatgaggagtgggaacctgagatctccttgggtcctggttgctggaactactggctgaaagacagtggttgtgtctgctgggcttgtcaagttccggtttgttgaaaggaaaaccccagctctgatccaatggtaattggggccacagagcagggcattcctcttccac

SEQ ID NO: 354263 - DNA, 1223 bp, Homo sapiens
gcgtgtgtgggacgcgagggtgcaggaagatggcttaccatagttttaggttggagcttactgacatattgcatccgtgactagctgcgtccgtattatcctaccatcgcacatgacagtacacatcgacccagcgcggcgaacgcggacacggttgcgtagaatatcgaatactacccaacgcatttgtgtacgatgttctgtaagcgtttcatattacacttgggaaattctaattccatatctagagaacgatctctatcacagaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354264 - DNA, 1052 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354265 - DNA, 1607 bp, Homo sapiens
tgggatcttcaggtcggaggccggggtgaggccgacccacaggccgccttgctccctcgcgaagacgcttatgccagtctcgcccgtccccgctcctcctcagagaaaatgctgccccgcagcacttaccggagcgaccatgagggtgacgatttgaagcacacacaggcttcccgccacctcctttaaaccgccgctggcttgccagggacagacggcgcggttggctccccaaaattccgactgatacgcgcctcggcgagcgaaagcaaacgcgggatactctcgcgttcctgattggctggttgtggacacctcaattatgacagaaaggggccgggcgggaaagttagctgtggccggcggggattggcagaaggaacctgtacttactcgtttttcccggacgttggctggtggagaagagaggcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccgtatccttcaacaaacaacacgggaaaatgttgaagaacaccctggctcttcctaaagcttgtcatctgtctcccacagttctctagatcttagcttcagggcactatcatttattttacagcacattttctgtgacaagtttccaaacctagcagtcggacaggatgagcaagtcaaaggaacttttaacccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354266 - DNA, 1290 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctatttttcctagaatcagctgtttcttcaaggagccctggttcctttaaagtggagaatggtatttagaagcaagatctgggtgctagatgtgctcattgctattggagtgttgctattcccagatcctctcagtgaacagagcaatggagaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354267 - DNA, 1446 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccgtatccttcaacaaacaacacgggaaaatgttgaagaacaccctggctcttcctaaagcttgtcatctgtctcccacagttctctagatcttagcttcagggcactatcatttattttacagcacattttctgtgacaagtttccaaacctagcagtcggacaggatgagcaagtcaaaggaacttttaacccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctatttttcctagaatcagctgtttcttcaaggagccctggttcctttaaagtggagaatggtatttagaagcaagatctgggtgctagatgtgctcattgctattggagtgttgctattcccagatcctctcagtgaacagagcaatggagaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354268 - DNA, 493 bp, Homo sapiens
gtgggttgaccgtggcttgtgggttgaccgtggcttgtgggttgaccgtggcttgtgggttgaccgtggcttgtgggttgaccgcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354269 - DNA, 1451 bp, Homo sapiens
tgggatcttcaggtcggaggccggggtgaggccgacccacaggccgccttgctccctcgcgaagacgcttatgccagtctcgcccgtccccgctcctcctcagagaaaatgctgccccgcagcacttaccggagcgaccatgagggtgacgatttgaagcacacacaggcttcccgccacctcctttaaaccgccgctggcttgccagggacagacggcgcggttggctccccaaaattccgactgatacgcgcctcggcgagcgaaagcaaacgcgggatactctcgcgttcctgattggctggttgtggacacctcaattatgacagaaaggggccgggcgggaaagttagctgtggccggcggggattggcagaaggaacctgtacttactcgtttttcccggacgttggctggtggagaagagaggcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354270 - DNA, 1258 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtggtgagcagctgcagtgccaccttctcattatctgggctggatatgactgggtcttcaggaaactggggtttgggcctcggggaggcccagaggggctggtcccggggatgggtggaggcgtacagggattactctggggttcgagttggcgccaagaatgcttatccagtgacgcgagaagggagtgctgcttcatggggggtcagcagttggaattgatcacaccttttcagttgtacttcaatcctgaattaatctttaaacactttcaaatatggagattaatcaccaacttcttattttttgggccagttggattcaattttttatttaacatgatttttctctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354271 - DNA, 1855 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgtaaaaaaaaaaaaaaaaaaaaaaaaaaaaaaaaaacccgcgggggcctcttgtgtcggggggcgggaaaaagaggaggttttgtgaaagagggccccgtgtggtccttggcgtgtgtttcccgtggccccacggtttcttttgttccaaagggggaagaactctcttcgcgcgggctcctcccccatacataaggggagccggataaaaaattttccgagaataagcccccgggtttaacccccgcggattaattttaatttctgcgggaaaaaaatgccaacgacgagatctaacaaccacaccacattaatagaaagcagcagacagatcaagagaggacaacacaaagaggaaaatcacgacgaagaagaaacaacacactattgatccaagcagaacagaaaataaccgagaggacgggccgaaaagacacaaaaaaaaacacacaagcgaagtagcacaacagaggatgaaatgaaattgcgacaagaagcacaagaggaaccaccgcaactttatatccccagcaagaaaaatggcgcacaagcaaaaaaacgcaaaatccagacagaacaatgggacatcaaataaaaacgcagagataggccacgacaacttaagaaactgataaagacagagaacaaaacaacgacgataaaacgtgaaaaaaaggtaagcacagaaacaaacaggtcaaggagacaccaaa

SEQ ID NO: 354272 - DNA, 1145 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccgtatccttcaacaaacaacacgggaaaatgttgaagaacaccctggctcttcctaaagcttgtcatctgtctcccacagttctctagatcttagcttcagggcactatcatttattttacagcacattttctgtgacaagtttccaaacctagcagtcggacaggatgagcaagtcaaaggaacttttaacccaggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354273 - DNA, 1091 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgaccctttttggtctgtttgtgagcttagttttcttgggccaggcctttacaataatgctcgtctatgtgtggagccgaaggaacccctatgtccgcatgaacttcttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaatttatggtataaggcagagccttttcttcctcttcttgatagatgaggccatggtgtaaatggaagtttcagagaggacaaaataaaacggaattccatttttctctcactgta

SEQ ID NO: 354274 - DNA, 1209 bp, Homo sapiens
ggtggggggtggggcaggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgacccagtcggacaggatgagcaagtcaaaggaacttttaacccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctatttttcctagaatcagctgtttcttcaaggagccctggttcctttaaagtggagaatggtatttagaagcaagatctgggtgctagatgtgctcattgctattggagtgttgctattcccagatcctctcagtgaacagagcaatggagaaagctatttttgatacaccagatgaggatccaaattacaatccactacctgaggaacggccaggaggcttcgcctggggtgagggccagcggcttggaggttaaagcagcagtgccaataatgagacccagctgggaaggactcggtgatacccactgggatcttttatcctttgttgcaaaagtgtggacacttttgacagcttggcagattttaactccagaagcactttatgaaatggtacactgactaatccagaagacatttccaacagtttgccagtggttcctcactacactggtactgaaagtgtaatttcttagagccaaaaaactggagaaacaaatatcctgccacctctaacaagtacatgagtacttgatttttatggtataaggcagagccttttcttcctcttcttgatagatgaggccatggtgtaaatggaagtttcagagaggacaaaataaaacggaattccatttttctctcactgta

SEQ ID NO: 354275 - DNA, 792 bp, Homo sapiens
gcggcggcactgttcgagccgccctgcagcggtgtggagactccgaccagttggggcaggcggctcaggtcgcggccagccaggggttgggaaactagtttccatggccaaacctagcccaccgtctgttttgtttcctgttcttcccaacctgcgctatggacttcatcagatttcagcatcagagagaatatggaaggacatcgaccctaacttcatccagtgaggatttccacacaccatacactctctgagagttcttttggctttgtgtgcacacctccagtgacagggagctcgctatgtcatgaggcagcctgctcccttgtggctatcactgaaccaactattaagccttcttatacaaacagtccctgacttactgttagacttacaactttttgattttacagtggtgcaaaagcaatatgcattccatagaaactgtatttcaaattttgaattttgatcttttccaggctagcaacatatgaagaccaaccttctatttttaaaataggctttgtgttagatgcttttgcccaactataggttaatgtaaatgttctgagaatatttgaggaaggctaggctaaactgtgatctttgggagcttagatatgttaagtgcattttcaacttacaatattttcaacttacgatgagtttattgggatgaagcccgttgtaagtaaaggagcatctgcattaagctaaaatccatgtctataacttcctcagtaatatcaagtttgttccttggagccagagaataaactgaatccttttcca

SEQ ID NO: 354276 - DNA, 854 bp, Homo sapiens
gcggcggcactgttcgagccgccctgcagcggtgtggagactccgaccagttggggcaggcggctcaggtcgcggccagccaggggttgggaaactagtttccatggccaaacctagcccaccgtctgttttggtgtccatggattggcggggacagctctgcttaaggatgtagtagctctgcaggttggctagtttcctgttcttcccaacctgcgctatggacttcatcagatttcagcatcagagagaatatggaaggacatcgaccctaacttcatccagtgaggatttccacacaccatacactctctgagagttcttttggctttgtgtgcacacctccagtgacagggagctcgctatgtcatgaggcagcctgctcccttgtggctatcactgaaccaactattaagccttcttatacaaacagtccctgacttactgttagacttacaactttttgattttacagtggtgcaaaagcaatatgcattccatagaaactgtatttcaaattttgaattttgatcttttccaggctagcaacatatgaagaccaaccttctatttttaaaataggctttgtgttagatgcttttgcccaactataggttaatgtaaatgttctgagaatatttgaggaaggctaggctaaactgtgatctttgggagcttagatatgttaagtgcattttcaacttacaatattttcaacttacgatgagtttattgggatgaagcccgttgtaagtaaaggagcatctgcattaagctaaaatccatgtctataacttcctcagtaatatcaagtttgttccttggagccagagaataaactgaatccttttcca

SEQ ID NO: 354277 - DNA, 571 bp, Homo sapiens
aaataaactgcgtgtcaggatgctattaccatctatattttgttctgagtgctcaactatacttgttctcatgacccgaagtgggtctgcttcctcctctcacccctttatcccaacctgtacacaggtgccatggcactgggtccaggccctgctcagtgactttggtcatccatttccagcaacatctatacccaagacaggatatgtctacagtctgttgggataggttatttgcctcaagtgctgctttctcagatcctagaaaggccaacagaagcctggcaactgccttcaattgctgtatcttaaaattgttggaatatcccataactaattgctaattagttattgccataataatgctgcttagcaaataacgaccaaattgaagtgccatacaataataaagcatgtatttctctctcaggtgtccatggattggcggggacagctctgcttaaggatgtagtagctctgcaggttggctaggttagtctatggcatgtgtctctatttcttctgtgatgcccaccaagggcatgtttttcacatggcacaagatgggtga

SEQ ID NO: 354278 - DNA, 389 bp, Homo sapiens
tttttttttacatagttgttatcttaaggtgatttccaatttttttttccatttacatttttccacaagcattgtccactttattctgtaaccttttcaactaccattttgaaatttgcttttatccatgtggttgtttgtgatgaactacaggttgctgactttcttccccttctgtaaataaagttttcttcctagtatgtcctgtatctcaagaggatctcatcagtggaatcattagatcaaaggatatgactgttgctcagctctctgtgtgtatgtaaattaataggctgtttatttgagcagttgtaggcttacaaaaatattgagtcaaaagtatagaattcccatatattctcctcttctcccttctgtcgtcttctcgc

SEQ ID NO: 354279 - DNA, 312 bp, Homo sapiens
tcctttgagcagtaagagaaaaataagaattattattgtaccatattaaactcttctgcagtggccatttaccagaatgttctaaatttaaaaactgaaagaaagttgaggctatagtggagcagaaaaggatttcatatgtaaagttaaaattccctagattttgctacaacttggcacttttaagtgcgttcttgctgattaaatgttcaactctcactcaatcagcccgctttcaaagcctggtatttcttttacttgcatgtaaggaaaatgcagtcatccaataaaaattctggagacatttccttg

SEQ ID NO: 354280 - DNA, 2737 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354281 - DNA, 2660 bp, Homo sapiens
ggcacgaggggaggaaggaggaggtcaccgtccagctgtctctcccctgtccccacatgtcttctaagctgttggagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354282 - DNA, 475 bp, Homo sapiens
gctcccaagcccaggctttggaggctgtctcttacctcaccctataaaagcaatggacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354283 - DNA, 2625 bp, Homo sapiens
ctggtacgccccggattacgggatctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354284 - DNA, 2842 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgagatgtggaatgaggttcatgaggaaaaggagcaggctgcaaagcagagtgtgtcctgcgatgaatgcataccattaccccgcgccgggcactgtgcaccttcggaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354285 - DNA, 1936 bp, Homo sapiens
gaaggaacagggaggggagggcgtgcctagagttgttggctgttccgcaccttctccacaggtccgggttttcactttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttgatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354286 - DNA, 1946 bp, Homo sapiens
aaaaaaaaaaaaaaaaaaaaaaaaaaaaaaaaaaaaaaaaaaaattcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354287 - DNA, 2931 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtcaaaaaaacacaacccacacagtccgcaggatccaccgctcgctgtcggcggcacaaagcgggtcaatggaaacgcggccgccagggccaacaagcctgtcgccgtgaaccccagccctgtctacaacggcgaacaacccggacggtaccacctataggcacacggaaacatcgcaaccgcacgtacccccctaga

SEQ ID NO: 354288 - DNA, 1943 bp, Homo sapiens
gtcctggagggtcagactctttggcaagagggaggaccaggaatggagccgtccttgtgcctgcctctttcagctgctgtggcggccaccccttccccacctcctggccaggccaggctggctgctgcttcaggcacccctgcctcccatcggccctctcttccctgcctgcatggcaggcagagggctgtcggatacctgggtttggtcatacccaccttggtcctcttgcaaattgaccctttcctcatctcttctagctctgctggtggcagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354289 - DNA, 1812 bp, Homo sapiens
gcgctctgaggctcctggggagtcggtgggaacgacaccagaagctcaggtggagatcttatcttcctgaggctgctggatttggtgggcgataggaatcaggccccctttttttggctgtgggagaaagaggggtgactgcggatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354290 - DNA, 3234 bp, Homo sapiens
  misc_feature (2942)..(2942): n is a, c, g, or t
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtcataaaaaaaaaaaaaaaaccaccacacaaaaaaaatttgtggggggctggggcctcggaaaagtttttttaaaccactttgtgttggggggcgggggccccatgtggtgtatggtgaacactgtggcacagggggtcccaagaggaaatcggggcctgaacataggggttgggttccctcacccaataaaaaaagcgcgcggcggncaccggcgcgtttgtgaaacaaactcgagatggccgatgggccgagactgggcgcacaccaagaggcccggcggggcgatagataaccggccccgcggcgagtggggcacaacagaaacgaaagagcagcacagaacagacaaaaacgaggaagaccgtacaaaagagaaaaaagacacaccacgaagaagacagagacgacaaacaagacgaaaagaacacaaggaccgagacacgacaaggagcagaggacaacaaaacagaacaaaaaaaagccgaaaagagacgaggt

SEQ ID NO: 354291 - DNA, 2816 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctcgtctctcgtgtctggtgtcctggcatggagtaccttgattctactccctgtaggctctcggagatcgtgcagtgagctccactgttggtccacgaaggcccatcgcgccccttgggtctccacttcgagattccatacattagaacaccccttgtgtttgtctggcttggggcttctcgccatgacttgtagcccacatctcatcccgggtgcgccttaagggtaagccgtaggccgaaatagagaaggctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354292 - DNA, 1823 bp, Homo sapiens
gaaggaacagggaggggagggcgtgcctagagttgttggctgttccgcaccttctccacaggtccgggttttcactttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttgatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354293 - DNA, 2635 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctctgtgctgtcacagcacagaggaggacactaccccaagaaagaccctgcgcctccagaggtcctccgtagggtctttcttgggatagtgttctgctcctgcttttctgtcctgggcatgggtccagggcctgacaccccctcagaggagccagtgtaccacagcattgtgtaaaaacgagtaaggcaaataataagaaatccgccagcccctccctcctctgtgctgt

SEQ ID NO: 354294 - DNA, 1609 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtctgagtctggctctcccatggcatacctgggaagggtcttaccctttggaggcatctccaaagtgctgccttcaaatgttagtgtgta

SEQ ID NO: 354295 - DNA, 624 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccccttgcaccctcattgctgttcagattaaagcctctgttttgcacctgtca

SEQ ID NO: 354296 - DNA, 261 bp, Homo sapiens
gactcgtagaggatccccattcgtgctggtgctagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354297 - DNA, 308 bp, Homo sapiens
ccatagcattgtgtatgaaataggtagtgaaacaggtggaaataacccaaacatttaacagtgaggaattaaattaattataatgcagtggcacgatgaaatgttattcacttagtaaaagttgtcataagattatgtttatatgtagatgtggaatgaggttcatgaggaaaaggagcaggctgcaaagcagagtgtgtcctgcgatgaatgcataccattaccccgcgccgggcactgtgcaccttcggaggtatttatcatcagccccattttttagacgaagaaactgagaggctcagagttag

SEQ ID NO: 354298 - DNA, 1545 bp, Homo sapiens
  misc_feature (56)..(56): n is a, c, g, or t
  misc_feature (527)..(527): n is a, c, g, or t
  misc_feature (594)..(594): n is a, c, g, or t
tctcctattttcactgtggggcgtttttttctctctgctagcctcctgatgtaggngcgcacaatcattctttgttgttcttcaccggcggctgcttccccctataaaagtgaggttaaataccctcttggtctcccatcctggggagaatagccgtgctgcccccctctttcggcggttatatagggcttgcccttggagggcctttcactctatggggggaagggggggccccccacataaatttggaataattgtggggcttttgaatgagatccatcatcgtttcctctttctttcacgcagcgggaaaacacttcttgtgttctccccccttcgcggcctctacagtggagataaagaccgtgggggtaatttcgcgccctaggaaatataaaatcctttccatcaagggcggaaaatgagggggggccctctttttggggggggggccccccacactatgtgggttaatatcttggcgcagggtgagcccctccctcgcgggaatatgttgccgcctctcntgtttggggcccaccactttctttttaatgggcgcccccggccgccgcaccaccacttttgtctggnccataaaacaccttctttggtgcccgctcttggtgtctcttgttggaagaggccgccttgcacaacaccccttcgggggggcccccaccttggggggcgcccctccggcgttgtttcttatctttgacttttcccccaccttcgggggtatgatattagcggtgtttggggggcgccccacacgagaaaacttgttggtgcggccacaagttgtcgcaacacaccaccacacctcttgtgtgcttcgtctcgccaacactcttcgtcccccgttgagaccctcggtgcccacatatcgcgtcttataatataaagggcgtgtgaaagggtataatagagagacacacacgcgctctcccacaaggccccacagagccttttggggcgacacatacacaggagaaatcggggcgccccacagctctgggggcgtctttgggcgcacagggcgccactctgggagagggcgcacccccgccctgagaggtgttttctccctctataggggcgtctgtgttctctctggcgcctctggcgttctgtacaccagggtgttctgttccccctcacgggcgctctgccctcttcttccacacttgcgcccccttctctcttgttgttcttgggtgcacacacaacacacacctctctcacaggagaagggggagagcacactcgagagagaagcaccacagcaacacgggggtctctcacagcctcgggaattcccggtggatggttctgggcacagaaggctgggttacaggagagtccccacaaaggtcacagtagacacgttgttctcaagaaagaaggcccacgcgtgccacacctcttcttcccacagggccacagaacaaccccttcctggctcccccatccccctatgggctcccagccccttgcaccctcattgctgttcagattaaagcctctgttttgcacctgtca

SEQ ID NO: 354299 - DNA, 1815 bp, Homo sapiens
atcagatttcagctggaagggaaggagctgacaggaaggcgctgtgcagagcctccccacccccgcccatccccccagttactgacagaggagccatttacaaaaggccgattctctggggagtggagaggcaggaacgcagcgtctatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354300 - DNA, 2744 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccaggcatacgctgactacatcggattcatccttaccctcaacgaaggtgtgaaggggaagaagctgaccttcgagtacagagtctccgagatgtggaatgaggttcatgaggaaaaggagcaggctgcaaagcagagtgtgtcctgcgatgaatgcataccattaccccgcgccgggcactgtgcaccttcggaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354301 - DNA, 1717 bp, Homo sapiens
gcgctctgaggctcctggggagtcggtgggaacgacaccagaagctcagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354302 - DNA, 2499 bp, Homo sapiens
ggaggttaagatcacagccacagagtgaggctcttactctctctgaggccataagtcttgttccaccccagccaggaggtgcctaacatactctgttttctgtggccaaaggtgtgggaggaggccctggtcagtcttggcagatccaaccctcgcatgcccagaacggctcctgtgagagctagtgtccaggtgtggcaggcatgggggtgctgttgcgggagctgcagctggaagctggggttggctgcctgtgggccaggccagcttctgtgataggccctgtcacttgctctccagctctgctcctctgctaggagcccgggctgggctgggctcagggagtcgggcctcccccgtgctcagccattcccctgttcagcgctctttttcccctgccccccacacaggctgctgggaattgcccaggggtggggggaactcagtgtcagctggttcttattgtctcgctctgaagtgccaagatgcctttttcagtccagagaactgaaagctggagaaaacaggctttgggacccggcctcagcctcttaggcttacgttcaaatgtccccacgtctcttctctagaactgggacctgggctgggggtccccagtgatcaggagggttctttccacctcaggttcccaacttccctctctgggccaagtgatggcacctggctgcctctcttctcggtttctaccttgtaggtttgggctgccttttctctttctctctctcgtgggtctcgttgtggagtgggtgtctttggatagaaggagtgaggaactgggggaggaaggcctgggggatcccctggcggggctacttcctgggcccgggatggacacctgggagctgctgcggttgttggggtcctggcaggggtgtggtgtggccctcaccactctgctcacctgctccttcctcacagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354303 - DNA, 2739 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccagccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagtgacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagcccctgcactataacttccgttggcgtgttcaagttaccctgggtttcgccccct

SEQ ID NO: 354304 - DNA, 2308 bp, Homo sapiens
atgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccagattcttcagaggaggcccctccagccactcagaacttcatcattccaaaaaaggagatccacacagttccagacatgggcaaatggaagcgttctcaggcatacgctgactacatcggattcatccttaccctcaacgaaggtgtgaaggggaagaagctgaccttcgagtacagagtctccgaggccattgagaaactagtcgctcttctcaacacgctggacaggtggattgatgagactcctccagtggaccagccctctcggtttgggaataaggcatacaggacctggtatgccaaacttgatgaggaagcagaaaacttggtggccacagtggtccctacccatctggcagctgctgtgcctgaggtggctgtttacctaaaggagtcagtggggaactccacgcgcattgactacggcacagggcatgaggcagccttcgctgctttcctctgctgtctctgcaagattggggtgctccgggtggatgaccaaatagctattgtcttcaaggtgttcaatcggtaccttgaggttatgcggaaactccagaaaacatacaggatggagccagccggcagccagggagtgtggggtctggatgacttccagtttctgcccttcatctggggcagttcgcagctgatagaccacccatacctggagcccagacactttgtggatgagaaggccgtgaatgagaaccacaaggactacatgttcctggagtgtatcctgtttattaccgagatgaagactggcccatttgcagagcactccaaccagctgtggaacatcagcgccgtcccttcctggtccaaagtgaaccagggtctcatccgcatgtataaggccgagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcacctcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtca

SEQ ID NO: 354305 - DNA, 414 bp, Homo sapiens
gggagagtgaagtcagatgaaagtgggttctacccaggtttcagaaggcaaaataaaacaaaataaagtgggttgaagattgaaaggatataaaggtagaagagacaactcatgtgtctgcccttggataggtgcagaataatgggagagtgattggaaaggaatgtgggatagagaaaaattttaaagaacatgtttatataatgataaaaaataatccagtattgaaagagcaatagatggtgcgtgaaagagaggagagaacaaggagaacataacttgagctggcaaaaagaattgagatctagatctctgaaaaattagttacccttcccaaggacctagtgtttaatatcataacgcctccccagcatcccacttctgatctttctgtaggggaaagaaaatgcatca

SEQ ID NO: 354306 - DNA, 479 bp, Homo sapiens
atgagaagttatttcagctgctgaggtaacagactttgacggcagtaactccagtgtggggaggtcagcaagctgctttatgtagcagctaccacacttcagcatagccattgcccttgtgtagggtccgaacgttggttgcagacccaggactcctgcatctggtctgtaatgatttcctactctctagatgatctgaattgatttctgattactcctggactctaggctcccccacccctctctgccatcagctttgttccaggaagccccatttataccctaactttcacttcccactcctcttccaagaggaaccatgtccctattaggaaaagattttgtccttgcaccaggggttaagagaattgagagtaggagaggtgatgtctgtaccatgtcttttagttggtctcagtttttaaaaaggtctagtgaatgctcagttggattagactgtgtggtaagtgaaaaaagaa

SEQ ID NO: 354307 - DNA, 3115 bp, Homo sapiens
cgggcttgcggcggttgtgccgcatctagagagtcggggagccgcccccgcacccaggccttctcgcgctgcctggtcgctggtgaagcccgcggcgcgcgcctctcccggaccctgcaggatttttcttcctggcctggttcccttgccttctccatttgcttcattcgcttggattttcaagaagctttgaagctggataggagtctccagtcttcctcttgatccatatgtttcaggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacgggaggtggaggcaggaggattacttgagatgggattttgagactctagtgtacttatgattgcacctgtgagcagccactgcactccaacctgggcaatatagcgagtccctttctcttaaaaaaaattgtagtgtttccacttttcttctgatatttttgtctatttcactactggataatgccaatataaaaatttgggtataatcaagaataagaggtaaactactaaataaaaaaagctttccaactg

SEQ ID NO: 354308 - DNA, 3969 bp, Homo sapiens
cgggcttgcggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggtaaggttacaatatataaatttgttttaaatgtctgtttccttgacagaaaagccaatctcagactttttgttaggaaaaagaaaatttttggatacaataaaaattttatcctgataagatggcttggtttgataggaaatgcaagatagatcagttaatatagggaataattatatatgtactttaataaaatagtgaggacaataacaattttatagttgaaactgtaaaaaactataaccattaattcttggtctacttgtaagagtgagaatttacagtgctgcgctctctatttttattaaggagagaagaaattaattcatttgtataatgaattcaagctagttttttttaagtttcttaattaaaattcttgattaaggaatatcgtgaaatctttatccctgataattctagcgtttaggaatagttctaccccaggcagatctattgaaaatcttttccagctctgggatttcttgaatccttgctgcattcatcagaaaggaaccctgtgtaattttgttgcttcttacttttagccaggggtgctagcagtgtcacagtagttatcattgtccacacaattgatactttgtgaagtcatatcgcacttgcacattttacatcaaatgcatggtgaaaaccattttgaactggggtgacagaaataggaaagtctggaggagctgatttgaaggggtaggaggtaggaatgaagatagtgggtaggatattggcaagattcaggtcctagatgctaaattggctggaaaattcaacttttacttttttaacagaaccatttcaatatgaagtcatgtttgaaaaaatgattttaatttgtaaagggttattttaagttcattacaaacaataaatcatggatggattcattgttagcacattatataaatgttatacttaaggtgttttgttttgttttgttttgtttcccttaaataggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacgggaggtggaggcaggaggattacttgagatgggattttgagactctagtgtacttatgattgcacctgtgagcagccactgcactccaacctgggcaatatagcgagtccctttctcttaaaaaaaattgtagtgtttccacttttcttctgatatttttgtctatttcactactggataatgccaatataaaaatttgggtataatcaagaataagaggtaaactactaaataaaaaaagctttccaactg

SEQ ID NO: 354309 - DNA, 3290 bp, Homo sapiens
cttgggaacaatacttatattggattctatttattttgatgactttgtttcacactgtgacatattgggcatgggtctataaccttaagggaccagtagatctcattctaaactgtattatagggaagtttctttttttggcagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggtaaggttacaatatataaatttgttttaaatgtctgtttccttgacagaaaagccaatctcagactttttgttaggaaaaagaaaatttttggatacaataaaaattttatcctgataagatggcttggtttgataggaaatgcaagatagatcagttaatatagggaataattatatatgtactttaataaaatagtgaggacaataacaattttatagttgaaactgtaaaaaactataaccattaattcttggtctacttgtaagagtgagaatttacagtgctgcgctctctatttttattaaggagagaagaaattaattcatttgtataatgaattcaagctagttttttttaagtttcttaattaaaattcttgattaaggaatatcgtgaaatctttatccctgataattctagcgtttaggaatagttctaccccaggcagatctattgaaaatcttttccagctctgggatttcttgaatccttgctgcattcatcagaaaggaaccctgtgtaattttgttgcttcttacttttagccaggggtgctagcagtgtcacagtagttatcattgtccacacaattgatactttgtgaagtcatatcgcacttgcacattttacatcaaatgcatggtgaaaaccattttgaactggggtgacagaaataggaaagtctggaggagctgatttgaaggggtaggaggtaggaatgaagatagtgggtaggatattggcaagattcaggtcctagatgctaaattggctggaaaattcaacttttacttttttaacagaaccatttcaatatgaagtcatgtttgaaaaaatgattttaatttgtaaagggttattttaagttcattacaaacaataaatcatggatggattcattgttagcacattatataaatgttatacttaaggtgttttgttttgttttgttttgtttcccttaaataggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacgggaggtggaggcaggaggattacttgagatgggattttgagactctagtgtacttatgattgcacctgtgagcagccactgcactccaacctgggcaatatagcgagtccctttctcttaaaaaaaattgtagtgtttccacttttcttctgatatttttgtctatttcactactggataatgccaatataaaaatttgggtataatcaagaataagaggtaaactactaaataaaaaaagctttccaactg

SEQ ID NO: 354310 - DNA, 1212 bp, Homo sapiens
  misc_feature (1102)..(1102): n is a, c, g, or t
  misc_feature (1109)..(1109): n is a, c, g, or t
  misc_feature (1113)..(1113): n is a, c, g, or t
  misc_feature (1116)..(1116): n is a, c, g, or t
  misc_feature (1120)..(1120): n is a, c, g, or t
  misc_feature (1126)..(1126): n is a, c, g, or t
  misc_feature (1128)..(1128): n is a, c, g, or t
gagacagggtctcgctctgttgccccaggctggagtgcagtggcatgatctcagcttactgcagcctcagtctcccaggctcaagcgatcctcccacctcggcctcccgagtacctgggactacagacaccaccacacctggctaatttttttattttttatagagacacagtctttccatgttgcctatgttggtcttgaactcctgggctcaaataattttcccaccttggcctcctgtagtgctgggattacgggcataagccactgtgtcaggccccatgtatgttaatagtgaatgtttggcttttcatttgttactttcagctattaaaggatacctattacagacacaggaatttacattttcaaagtcatttttgacacatcagtgctgcatctacttttctccttttagcacatttgatattgatacttcagagaaacttttttaactacccttaaaatcttgtcaatgaccattaactgccaatcatcacctcatttgctttttttgacaacatactactagaaacctaggctgtgagtgtaaaaccataactgttagaatcattttttggcaatagctcacattctgttaagagtcatttgctttaatcaaagatcatgatttattatatattttttataagtagggatggggccaagattattcctttggcacagcagtaagtgtgctcaagatctttgcctgtaagcttgaatatttggcttaaattttgtgcatatgaatactgttaaaggtatatttgactacattttgaaaggaaaaaggtagtcctgctaaaattgacatttagggatattttaatctatgtatttggtaaagtaattagtgaagtattagttataaaaattttaaggaaaacatttaaaagcaaaatagtcgtatcagataaatagagtagaatacactaaagataaaacaagtctctgttacaaatgaagttgtctgtacagacgactgagatattttaattttatttacataaaaatgctgttcaatatctaatgatttctgttgtttgtattctgtactttagagtaataatagttggttctccaaaaaaaaaaaaaaaantgtgggngcgnccnaaantttaancnttggcggccaaaaaatcatcggcaacggggtggggtcccaaacgggcgtgacacattgtgtcccatccccgccggaggaggaga

SEQ ID NO: 354311 - DNA, 1093 bp, Homo sapiens
gagacagggtctcgctctgttgccccaggctggagtgcagtggcatgatctcagcttactgcagcctcagtctcccaggctcaagcgatcctcccacctcggcctcccgagtacctgggactacagacaccaccacacctggctaatttttttattttttatagagacacagtctttccatgttgcctatgttggtcttgaactcctgggctcaaataattttcccaccttggcctcctgtagtgctgggattacgggcataagccactgtgtcaggccccatgtatgttaatagtgaatgtttggcttttcatttgttactttcagctattaaaggatacctattacagacacaggaatttacattttcaaagtcatttttgacacatcagtgctgcatctacttttctccttttagcacatttgatattgatacttcagagaaacttttttaactacccttaaaatcttgtcaatgaccattaactgccaatcatcacctcatttgctttttttgacaacatactactagaaacctaggctgtgagtgtaaaaccataactgttagaatcattttttggcaatagctcacattctgttaagagtcatttgctttaatcaaagatcatgatttattatatattttttataagtagggatggggccaagattattcctttggcacagcagtaagtgtgctcaagatctttgcctgtaagcttgaatatttggcttaaattttgtgcatatgaatactgttaaaggtatatttgactacattttgaaaggaaaaaggtagtcctgctaaaattgacatttagggatattttaatctatgtatttggtaaagtaattagtgaagtattagttataaaaattttaaggaaaacatttaaaagcaaaatagtcgtatcagataaatagagtagaatacactaaagataaaacaagtctctgttacaaatgaagttgtctgtacagacgactgagatattttaattttatttacataaaaatgctgttcaatatctaatgatttctgttgtttgtattctgtactttagagtaataaaataagtttgagtatctcatt

SEQ ID NO: 354312 - DNA, 1470 bp, Homo sapiens
  misc_feature (1360)..(1360): n is a, c, g, or t
  misc_feature (1367)..(1367): n is a, c, g, or t
  misc_feature (1371)..(1371): n is a, c, g, or t
  misc_feature (1374)..(1374): n is a, c, g, or t
  misc_feature (1378)..(1378): n is a, c, g, or t
  misc_feature (1384)..(1384): n is a, c, g, or t
  misc_feature (1386)..(1386): n is a, c, g, or t
cgggcttgcggcggttgtgccgcatctagagagtcggggagccgcccccgcacccaggccttctcgcgctgcctggtcgctggtgaagcccgcggcgcgcgcctctcccggaccctgcaggatttttcttcctggcctggttcccttgccttctccatttgcttcattcgcttggattttcaagaagctttgaagctggataggagtctccagtcttcctcttgatccatatgtttcaggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctggctaatttttttattttttatagagacacagtctttccatgttgcctatgttggtcttgaactcctgggctcaaataattttcccaccttggcctcctgtagtgctgggattacgggcataagccactgtgtcaggccccatgtatgttaatagtgaatgtttggcttttcatttgttactttcagctattaaaggatacctattacagacacaggaatttacattttcaaagtcatttttgacacatcagtgctgcatctacttttctccttttagcacatttgatattgatacttcagagaaacttttttaactacccttaaaatcttgtcaatgaccattaactgccaatcatcacctcatttgctttttttgacaacatactactagaaacctaggctgtgagtgtaaaaccataactgttagaatcattttttggcaatagctcacattctgttaagagtcatttgctttaatcaaagatcatgatttattatatattttttataagtagggatggggccaagattattcctttggcacagcagtaagtgtgctcaagatctttgcctgtaagcttgaatatttggcttaaattttgtgcatatgaatactgttaaaggtatatttgactacattttgaaaggaaaaaggtagtcctgctaaaattgacatttagggatattttaatctatgtatttggtaaagtaattagtgaagtattagttataaaaattttaaggaaaacatttaaaagcaaaatagtcgtatcagataaatagagtagaatacactaaagataaaacaagtctctgttacaaatgaagttgtctgtacagacgactgagatattttaattttatttacataaaaatgctgttcaatatctaatgatttctgttgtttgtattctgtactttagagtaataatagttggttctccaaaaaaaaaaaaaaaantgtgggngcgnccnaaantttaancnttggcggccaaaaaatcatcggcaacggggtggggtcccaaacgggcgtgacacattgtgtcccatccccgccggaggaggaga

SEQ ID NO: 354313 - DNA, 2997 bp, Homo sapiens
cgggcttgcggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagatgggagattctttggtcagagagacctacgaaggtgaatgcttcccaagctcgccagtttaaaccttgtattaagcagataaatttccccacaaatcttatacgactggaagtaaatagttctcttctggaatattacactgaattagatgcagttgtgctacatggtgtgaaggacaagccagtgctttctctcaagacttcacttattgacatgaatgatatagaagatgatgcctatgcagaaaaggatggttgtggaatggacagtcttaacaaaaagtttagcagtgctgtcctcggggaagggccaaataatgggtattttgataaactaccttatgagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacgggaggtggaggcaggaggattacttgagatgggattttgagactctagtgtacttatgattgcacctgtgagcagccactgcactccaacctgggcaatatagcgagtccctttctcttaaaaaaaattgtagtgtttccacttttcttctgatatttttgtctatttcactactggataatgccaatataaaaatttgggtataatcaagaataagaggtaaactactaaataaaaaaagctttccaactg

SEQ ID NO: 354314 - DNA, 3623 bp, Homo sapiens
cgggcttgcggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaagcttattcagctgattctgaatcatcttacactaccagacctgtgtagattagcacagacttgcaaactactgagccagcattgctgtgatcctctgcaatacatccacctcaatctgcaaccatactgggcaaaactagatgacacttctctggaatttctacagtctcgctgcactcttgtccagtggcttaatttatcttggactggcaatagaggcttcatctctgttgcaggatttagcaggtttctgaaggtttgtggatccgaattagtacgccttgaattgtcttgcagccactttcttaatgaaacttgcttagaagttatttctgagatgtgtccaaatctacaggccttaaatctctcctcctgtgataagctaccacctcaagctttcaaccacattgccaagttatgcagccttaaacgacttgttctctatcgaacaaaagtagagcaaacagcactgctcagcattttgaacttctgttcagagcttcagcacctcagtttaggcagttgtgtcatgattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggtaaggttacaatatataaatttgttttaaatgtctgtttccttgacagaaaagccaatctcagactttttgttaggaaaaagaaaatttttggatacaataaaaattttatcctgataagatggcttggtttgataggaaatgcaagatagatcagttaatatagggaataattatatatgtactttaataaaatagtgaggacaataacaattttatagttgaaactgtaaaaaactataaccattaattcttggtctacttgtaagagtgagaatttacagtgctgcgctctctatttttattaaggagagaagaaattaattcatttgtataatgaattcaagctagttttttttaagtttcttaattaaaattcttgattaaggaatatcgtgaaatctttatccctgataattctagcgtttaggaatagttctaccccaggcagatctattgaaaatcttttccagctctgggatttcttgaatccttgctgcattcatcagaaaggaaccctgtgtaattttgttgcttcttacttttagccaggggtgctagcagtgtcacagtagttatcattgtccacacaattgatactttgtgaagtcatatcgcacttgcacattttacatcaaatgcatggtgaaaaccattttgaactggggtgacagaaataggaaagtctggaggagctgatttgaaggggtaggaggtaggaatgaagatagtgggtaggatattggcaagattcaggtcctagatgctaaattggctggaaaattcaacttttacttttttaacagaaccatttcaatatgaagtcatgtttgaaaaaatgattttaatttgtaaagggttattttaagttcattacaaacaataaatcatggatggattcattgttagcacattatataaatgttatacttaaggtgttttgttttgttttgttttgtttcccttaaataggaacaagaatggtaagtccggcatccttaagaaaactcctggaatcttgtaaagatctttctttacttgatgtgtccttctgttcgcagattgataacagagctgtgctagaactgaatgcaagctttccaaaagtgttcataaaaaagagctttactcagtgacttaatatatgttctgtattaaaattaatgtgctttgttggggtttaattttgggattggttttgggttttgtttttagttgttttaatggtaagaattaagacatttgtagattttaaagaaaaatatgaaattgtccattaaatcaagtaaaaatgtgcacaaatgttttcataaaatactgcaagcacttctcttcaagaatatgagtggatattatttttaccttatgttaatcagtgatatgctttagtcaataatatgattgataaaagaataacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacgggaggtggaggcaggaggattacttgagatgggattttgagactctagtgtacttatgattgcacctgtgagcagccactgcactccaacctgggcaatatagcgagtccctttctcttaaaaaaaattgtagtgtttccacttttcttctgatatttttgtctatttcactactggataatgccaatataaaaatttgggtataatcaagaataagaggtaaactactaaataaaaaaagctttccaactg

SEQ ID NO: 354315 - DNA, 1044 bp, Homo sapiens
cgggcttgcggcggttgtgccgcatctagagagtcggggagccgcccccgcacccaggccttctcgcgctgcctggtcgctggtgaagcccgcggcgcgcgcctctcccggaccctgcagggtaaaagaatgtcacatgtcagcatttgtacctgaagtcagcatgcaaagttcagggtacctggatgaatgccaacttttgcatttcccatgtgtatcctgtgaccattctatctgggaacatccttcaaagagttcatgcatcttactgaggacacctgaccttttgaagcttcataattcacatctagatgtcaccggtctttcccatgttaacagttctgaccatgttttattatatatgccttcggcgccgagccaggacagctacaagaggagaaatgatgaacacccatagagctatagaatcaaacagccagacttcccctctcaatgcagaggtagtccagtatgccaaagaagtagtggatttcagttcccattatggaagtgagaatagtatgtcctatactatgtggaatttggctggtgtaccaaatgtattcccaagttctggtgactttactcagacagctgtgtttcgaacttatgggacatggtgggatcagtgtcctagtgcttccttgccattcaagaggacgccacctaattttcagagccaggactatgtggaacttacttttgaacaacaggtgtatcctacagctgtacatgttctagaaacctatcatcccggagcagtcattagaattctcgcttgttctgcaaatccttattccccaaatccaccagctgaagtaaggtaagactaattttttaatgacctaagttatatggtagaaaggttttggttgttaatattggagatcttttttattgcaagcattcttttaagtaacttaattgaatttgattttgaaaattttccttagttttctgatggggaagagagatcactcatataaagatttaatgcaggctttatacctgtaatacctcatacggtaatattctatgctgctg

SEQ ID NO: 354316 - DNA, 2896 bp, Homo sapiens
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaacaaacaaaaaaaaaaaaaaaaaagagcaaaaaaaaaaaactgggagaaatttcccacccgcgggaggggggggccacaaaggggaggggggggcaccgccggaaaaaacaccaccgcagtgtgttaaacgctcgccgggccggccaatggccgtccgaaaaaacgagcgact

SEQ ID NO: 354317 - DNA, 3982 bp, Homo sapiens
  misc_feature (929)..(929): n is a, c, g, or t
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgacctcctcgcgcgggcgcccctgccattcccgggaacaggggctcagcctctccctccctggaagaggacgttgtcgtggtttggaagagcaggggtgggcttagagcttccaattaagctattggcaggagtatccctgcagcgggtgaatgccgaggggcgtttgcncaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctgggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggagcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccgccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaacaaacaaaaaaaaaaaaaaaaaagagcaaaaaaaaaaaactgggagaaatttcccacccgcgggaggggggggccacaaaggggaggggggggcaccgccggaaaaaacaccaccgcagtgtgttaaacgctcgccgggccggccaatggccgtccgaaaaaacgagcgact

SEQ ID NO: 354318 - DNA, 1989 bp, Homo sapiens
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaacaaacaaaaaaaaaaaaaaaaaagagcaaaaaaaaaaaactgggagaaatttcccacccgcgggaggggggggccacaaaggggaggggggggcaccgccggaaaaaacaccaccgcagtgtgttaaacgctcgccgggccggccaatggccgtccgaaaaaacgagcgact

SEQ ID NO: 354319 - DNA, 4095 bp, Homo sapiens
  misc_feature (929)..(929): n is a, c, g, or t
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgacctcctcgcgcgggcgcccctgccattcccgggaacaggggctcagcctctccctccctggaagaggacgttgtcgtggtttggaagagcaggggtgggcttagagcttccaattaagctattggcaggagtatccctgcagcgggtgaatgccgaggggcgtttgcncaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctgggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggagcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaacaaacaaaaaaaaaaaaaaaaaagagcaaaaaaaaaaaactgggagaaatttcccacccgcgggaggggggggccacaaaggggaggggggggcaccgccggaaaaaacaccaccgcagtgtgttaaacgctcgccgggccggccaatggccgtccgaaaaaacgagcgact

SEQ ID NO: 354320 - DNA, 3206 bp, Homo sapiens
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccgtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaacaaacaaaaaaaaaaaaaaaaaagagcaaaaaaaaaaaactgggagaaatttcccacccgcgggaggggggggccacaaaggggaggggggggcaccgccggaaaaaacaccaccgcagtgtgttaaacgctcgccgggccggccaatggccgtccgaaaaaacgagcgact

SEQ ID NO: 354321 - DNA, 2894 bp, Homo sapiens
  misc_feature (929)..(929): n is a, c, g, or t
gctttcctctcctttctccctcccccttgtctgcgccacagcccccttctctccccgccccccgggtgtgtcagatttttcagttaataatatcccccgagcttcaaagcgcaggctgtgacagtcatctgtctggacgcgctgggtggatgcggggggctcctgggaactgtgttggagccgagcaagcgctagccaggcgcaagcgcgcacagactgtagccatccgaggacacccccgcccccccggcccacccggagacacccgcgcagaatcgcctccggatcccctgcagtcggcgggaggtaaggagcagggcttgcaaaccgcccggcgcccagggaagcgacgagcgccggggcaaggcaagccctggacgggattgcgacgtgcgcaccgggcgccctaatatgcccgggggactgtttctgcttccgaaacaaaaccatctctgggttttcccagaaaagccagttccagccccgaaggcatcctggctagaggagacccgccctaatccttttgcagcccttaccggggggagtaatggcttctgcgaaaagaaattccctcggctctagaagatctgtctgtgtttgagctgtcggagagccggtgcgtccccaccccaggctggggttcttctccaaagggtgcccctggaggaagaagagggggggattaggcagggcgaggccgccgcggtcgcaatctgggtcacggctgctccagcttggaggagaggcggctctcccggcgacctcctcgcgcgggcgcccctgccattcccgggaacaggggctcagcctctccctccctggaagaggacgttgtcgtggtttggaagagcaggggtgggcttagagcttccaattaagctattggcaggagtatccctgcagcgggtgaatgccgaggggcgtttgcncaaatttggggaggggaaggatttgtggatatgggtgtctgttgttggtctctgtctagagaaaggcttttttttatttgcaaagttttctaaatcccctgctatcatttgcactcctgaggttgcatttttacaaagggggtagaaggtactccaaataccattcccggtagctgggtcggagagcctgggcttcccctgagcagccggccccacaccgctgcgagtgcggttgtctgcgtgctcgtgagagctagaattctgcagccaggaacagccccctcccccaggcagtgccttgtgtgaatgaaatggcagtttccaaagttgcggagcctcgccaccaccccctgcatctgcatgccccctcccaccccctgtcgtagacagcttgtacacaaaaggagggcgggagggagggagcgagaggcacaacttcctccaccttcgggagcagtgggcagagtggggggcttggagggaagattggggaacctggttagagggggcgcccattgcctatcccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcctccctggggcactggaccccgggtcgcgtcccctttgttagtgctcgtatgtcttggcctggggagcattttggaggcagtgctaggggcagagaggtcctgtttcccccaagtctctcctcggggtaaagagaaggggctgagagaatgccgttgcaaaaggggtgctctccaattctcgccttcactaaagttccttccaccctctcctggggagccctcctctaggccatcacgggccctcacccggtcccccacctctcttttgcagcgcagtctgaggaataaaattggagaaagttggtggctaaaccgggtgggggtttagggggttgctgggtgcactgcctggacagaaacctgttagcgcaggggtgaaagggactctctggcccaggtcaggggagggaaagacatcccgagaagattcaagggctgtgcaaagccctgttta

SEQ ID NO: 354322 - DNA, 585 bp, Homo sapiens
agacgctggttcccctcgaccccatagtcatctcatcatgtggcatcttgaccagttcccctccatattcatttcctggaccatgtgaaagtcatcatagttcctactggttgtcctaagttcttcctggatacttgtgcgtgtgtgtacacttaccatattatatacatgtgtctctgggatatatatgtgtgtttgcctgcttatttcctatgttgtgaagcaatggccaacttatgtggggcaggccaaaattaagctcacgtgatagtcaaatttggtccagatgatgctcaaaatgatattcagacaaagcatgtcttgattctgatccttggatataaattttgtgcaacaggagctagagttgtaaaaaccacaagacaaaaccagctatgatttgatggtgtatttccaaaaacaaagtgctggtgtaacattctccatttaaggtagcccacttccagtggcttgttgcttcaccatataagggagtatgtgaaaagttttaacaattgcttgctgagaacatccggttctcattttgaaaggttaaaaaagaggggggaaaaggaaaaaaagaaa

SEQ ID NO: 354323 - DNA, 1850 bp, Homo sapiens
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccagacggagtttggttcttgttgcccaggctggagtgcaatggtgcggtctcggctcactgcaacctccacctcccaggccacggaccacaccttcctccagaagagccactatcaccatggtgaccaccccagctgtacctcacccgtctcagaatggggtccagggagaatttggttagggagaggtgctagggaggcctgagcagagggcaccctccgagtggggtcccagccttgagacagctgctgtgagggacagtactgaa

SEQ ID NO: 354324 - DNA, 228 bp, Homo sapiens
aattcaagcttctaacgatgtacggggacatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggc

SEQ ID NO: 354325 - DNA, 8165 bp, Homo sapiens
  misc_feature (2926)..(2926): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354326 - DNA, 8214 bp, Homo sapiens
  misc_feature (2926)..(2926): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagtaagcttggggacggagcctcacggtggggccactcccctgcccaggggccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354327 - DNA, 8205 bp, Homo sapiens
  misc_feature (2926)..(2926): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatggggcccctttaaaattaaccccaaagggaagaatttccccctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354328 - DNA, 4512 bp, Homo sapiens
tctcagacttggagtggtaatgattcctgcattgcccctgcttgccctctgagacagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccacagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354329 - DNA, 7600 bp, Homo sapiens
  misc_feature (2926)..(2926): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccaggtgggcacagctcttgcctcagcac

SEQ ID NO: 354330 - DNA, 1826 bp, Homo sapiens
ggctgcctagcaacttcctggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354331 - DNA, 6190 bp, Homo sapiens
  misc_feature (2997)..(2997): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccagcctgtcttcacacattcctccaacagctgttggctgaccgtctgcctcatctacccttgggccagatgctggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggc

SEQ ID NO: 354332 - DNA, 3097 bp, Homo sapiens
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccagcctgtcttcacacattcctccaacagctgttggctgaccgtctgcctcatctacccttgggccagatgctggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaagtaaatgataatctttgggaaaccaggaccctgcctcccagcccagaggtggaggagggcggtcagggtggggtctacagtggcacagcactgacaaaggtagagggaaatgtaatagcacatctacgctgcagtctggtgaaagtggccggggtggtccttggaaaacagttgggctgttcttggcaggaattagtgacagcctttccgtcacgggcagggacgccttgatttaaaataaataaataaataaaacgtctgggtatagacttttgaaa

SEQ ID NO: 354333 - DNA, 2600 bp, Homo sapiens
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccagcctgtcttcacacattcctccaacagctgttggctgaccgtctgcctcatctacccttgggccagatgctggcgacagagctggggatgccagagacggggcctcccaggctggttgggaagtcagattcagatggtagagcagccagtgatcttcccagagagtaactcgagggctgagaatgaagtgaagacagtg

SEQ ID NO: 354334 - DNA, 167 bp, Homo sapiens
gtccaggggagggcgaggcagacccacgctggcctctcgcttccagcaggccctggaggacctcatagcccggctgggcaggtaagaacagcgcccgccacaccagaccccagggagttgtatggggctccagtctgtgcccgagtgacccctctttccctcatcag

SEQ ID NO: 354335 - DNA, 270 bp, Homo sapiens
actggccctgggcagctccagggcatcttgggcagtagcaggacccaggagactgcccgagacccaccaccttcctgtagggcgagagtggcagcgacgtgcagctgttagccgtgtcccaccgtgggctgcgactgctcaaggtgacccaaggccccggcctccgccccgaccagctgaagattctctgctcatacaggtgcgctggcccacgaccctgggctagaggtgggggcaggtggcaaggtgaccccagttcatgcccgatcc

SEQ ID NO: 354336 - DNA, 382 bp, Homo sapiens
ccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggtgggcccccacggggaggtggccagggctgtcccgctcctcggggaatcaccctatgaacttagtgacctcttgcttctcccacgaggcctcccaaagctttcctgaggaaaatcgaccccaaggacgaggctctggccaagctgggtatcaacg

SEQ ID NO: 354337 - DNA, 545 bp, Homo sapiens
gacggagcctcacggtggggccactcccctgcccaggggtgaggtggtttggtttctgctggggtggcagggccgggtgtgtgtggtctgagcagcagtggacctaggctccccatgcaggccagctggtgcggcccctgcagcccgccgaatacctcaacagcgtggtagtggaccaggacgtgagcctgcacagccggcggctccactgggagaccccactgcacttcgataactccacctacatcagcacccactacagccaggtcagcctgcctgcctccgagctgctgctgcagtttgagggcgcggcttcctgcctgggcgacctccaagcccctctccccacaagggtgtgggtctgtggtggctggggggtgacagtggcaaaaggaggcttgagcctctagagccaccaactgatggggggctttggaccaccgctgccctcctcaccgtgctccccgcacaggtgctgtgggactaccttcaggggaagctgccagtcagcgccaaggcagacgcgcagctcgccaggctggccg

SEQ ID NO: 354338 - DNA, 8099 bp, Homo sapiens
  misc_feature (2926)..(2926): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccgctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354339 - DNA, 8236 bp, Homo sapiens
  misc_feature (2997)..(2997): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccagcctgtcttcacacattcctccaacagctgttggctgaccgtctgcctcatctacccttgggccagatgctggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354340 - DNA, 8108 bp, Homo sapiens
  misc_feature (2926)..(2926): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccaggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcatcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354341 - DNA, 2919 bp, Homo sapiens
gagagagagagagactagttctcttctctctcctttcctgtctcgggcgagagtggcagcgacgtgcagctgttagccgtgtcccaccgtgggctgcgactgctcaaggtgacccaaggccccggcctccgccccgaccagctgaagattctctgctcatacagctttgcggaggtgctgggtgtggagtgccggggcggctccaccctggagctgtcactgaagagcgagcagctggtgctgcacacagcccgggcaagggccatcgaggcgctggttgagctattcctgaatgagcttaagaaggactccggctatgtcatcgccctgcgcagctacatcactgacaactgcagcctcctcagcttccaccgtggggacctcatcaagctgctgccggtggccaccctggagccaggctggcagtttggctctgccgggggccgttccggactctttcctgccgacatagtgcagccggctgccgctcccgacttttccttctccaaggagcagaggagtggctggcacaagggtcagctgtccaacggggaaccagggctggctcggtgggacagggcctcagaggtgaggaagatgggagagggacaagcagaggcaaggcctgcctgagactgaggaaggaaaggggtttgaccactcccgaggctgccatgcggtgggaccaccctgctgtccgtctcctgtggctgcccctctgcccgctcctgatggctcgccttgtctctccagcaagactgtgcactccttgcaggcaggggctgggctggatgctgctcttgtgtcccacgtggtacttagttcaaggctgccccagcagatgcttaataaacagctcttcactttcctggcttctggtcttgctcctttggtgtctggctggggagggatggggctggggcaggacccctgggacagggcactggacactcaggtggcaccaggtttcttgtgatcccagcgccctgcccacccttggagccaggcacacagtgacgactcggaggccaccagcctgtcctctgtggcctatgcctttctgcccgactcccacagctacaccatgcaggaattcgcccggcgttacttccggaggtcccaggccttgctgggccagactgatggaggtgccgcaggaaaggacacggacagcctggtgcagtacaccaaggctcccatccaggagtcgctcctcagcctcagtgatgatgtgagcaagctggctgtagccagcttcctggccctgatgcggtttatgggtgaccagtccaagccccggggcaaggatgagatggatctgctctatgaactgctgaagctgtgccagcaggagaagctgagggatgagatttactgccaggttatcaagcaggtcacgggacacccccggccggaacactgcactcgaggctggagcttcctcagccttctcacaggcttcttccccccgtcgaccaggctgatgccctacctgaccaagtttctgcaggattcaggccccagccaagagctggcccggagcagccaggagcacctccagcgcacagtcaaatatggggggcgccggcggatgcccccaccgggtgaaatgaaggctttcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354342 - DNA, 1424 bp, Homo sapiens
taaatcgatcggccagtgtaaaacgacggccagtgtaaaacgacggccagtgtaaaccgatggccacgtgtaaaccgatgtcgggtgtaccgcgatgtcccgcgtacgacgaaggtgagtgttatcctgaaaggacaagcgattcgcctgcttcttattcacctgccggggggtgtggattataggacgaatatccagactttcacagtagcagcagaagtgcaggaggagctgtgccggcaaatgggtatcacggagcctcaggaagtgcaggaattcgccctcttcctcatcaaagagaagagccagctggtgcggcccctgcagcccgccgaatacctcaacagcgtggtagtggaccaggacgtgagcctgcacagccggcggctccactgggagaccccactgcacttcgataactccacctacatcagcacccactacagccaggtgctgtgggactaccttcaggggaagctgccagtcagcgccaaggcagacgcgcagctcgccaggctggccgccctgcagcacctcagcaaggccaacaggaataccccctcagggcaggacctgctagcttacgtgccaaagcagctgcaacggcaggtgaacacggcctccatcaagaacctgatgggtcaggagctgagacggctggaaggacacagcccccaggaagcacagatcagcttcattgaggccatgagccagctgcccctcttcggctacaccgtctatggggtgctgcgagtgagcatgcaggccctgtccggacccactctcctggggctcaaccgccagcatctcatcctcatggaccccagctcccagagcctgtactgccgcattgccctgaagagcctgcagcggctccacctgctaagccctctggaggagaaggggccccctggcctggaagtcaactatggctcagctgacaacccccagaccatctggtttgagctgccacaggcccaggagctgctatacaccactgtcttcctgatagacagcagtgcctcttgcactgagtggcccagcatcaactgagaggagtgcaggccggggagagaagaggatgaggcctcccccggcccaagtctcacccacatggtctgccttggatgctatcagatcactgttctagaacctgcctcagcacagcccagccggcccacatgcaggccatgaggcaggggctgctatcacgtcaccagcaggcaaagaaaacagccagaccctctccaggacggcctggggccaaagcgggctgcaggaactcggctggggcacctgaggttgcccagtctgagggagatgcccacccgaccccaggctccgcccaggccccacattagcacaagcccaggcatgggagaaacagctgctgaggaaataaaactccctggagaaaaaaaatg

SEQ ID NO: 354343 - DNA, 5597 bp, Homo sapiens
  misc_feature (2997)..(2997): n is a, c, g, or t
gggctccttctgcatctgctgggctgagcctgctggggtggggtgcagggatggagaggtaaaggagtggggctgcctctgaggatttagaatctctcaaggactagggctgtctgcgcgccttggagttctcgcttccactcacctccagaggacgatgcccctcaccccacacccacgttcatccaagcatggtctctgctcccttttctggtcctgggctgggcagcctgggccgggagtgctcctggcttctctgggatggctggagcccaccacaagccccagccctggcccgtgctgtcctcctgctgggaggagttgcttagtgcagcagacagagcagaggctctgagtggtcctgccactcactagctgtgtggccttgggcaagtggatgaacctttctgaggtccagcgttcccgtctgtaaaacagaattcccagcaggacctaccttgtgagtttcagaggcttaacggagatagtccatgagagagctgtgtgctccagggcagccgttctgtcccactctggccggtcctgcctttggcatggcctgtcctccgtggccttgtagagacgcaggagtctcaaaggcagtggaagacagaggccccagggtgggcccgcctgtagccccacttcccccacgtcaggaggaaagggaagagggagagtcccccagtctctctcagttggcagaggctctgcacccctttacagaggatcctgccgcctcaggacagccaggagggggctggagggagaggaggtggcccctgccctcagtccctggacgggcactattcatggccccctgttctgtcccacaatccagtgtgtccttgtgaccgtgccctccctgaggctggtggtgatggtggcctgtgtgtgcatccaagctcctgtgtgtgtgtttcaaggggcacaaagctgcatgaagcttcctaagagagtgctgagggagcacttcctataggaggaaggctggaaggcttcctggaggcagcagcctggagccctgtgcatgaggatgcgggactctgatagccaacctgctatttagtagggaaagtcgccttccaagccacaggatggccgtgacaagaggcccaaaggctcgcaggagtgctgcagcagagggcaggggtgtgggcagctagagggacctgtggctgggcagggctgaggtagcccgtgtgctgtgccggatcctttagacttgaccctgttggctacacagcatcagccctgggtattactcatccctgcgccctggccagaatgaaggaagcctctggggtggggggagggcacagccccatgtgcccacctcactgccacatgcccccaggccctgcgggtgaatggcctggagcaactgtgcaacaacctcgccagcgagcgcctacagctcttctccagccagatgctgctggcccaggaggaggaggagtgtcggcgggagttgctgtcctgggtgcctgtccctcagcctccgagggagtcctgcctagacctcctggtagatcagccccacagcctcctgagtatcctggacgcccagacatggctgtcccaggctggagtgcaatggtgcggtctcggctcactgcaacctccacctcccaggccacggaccacaccttcctccagaagagccactatcaccatggtgaccaccccagctatgccaagccccggctgcccctgcccgtgttcaccgtgcgacattatgcagggactgtcacctaccaggttcacaagtttttaaacagaaaccgggatcagctggaccctgctgtggtggagatgcttggccagagccagctccagctggtgggcagcctgttccaggaggcagagccccagtccaggggagggcgaggcagacccacgctggcctctcgcttccagcaggccctggaggacctcatagcccggctgggcaggagccatgtctatttcatccagtgcctcacccctaaccctggaaagcttccaggcctctttgacgtgggacatgtgacagagcaactgcaccaggcagccatactggaggccgtgggcacccgcagtgccaacttccccgtgcgtgtgccctttgaggccttcctggccagcttccaggccctggggtcagaagggcaggaagacctctctgaccgggagaagtgtggtgccgtcctgagccaggtgctgggggccgaatcacctctctatcaccttggagccaccaaggtcctgctgcaggagcagggctggcagcggctggaggagctccgggaccagcagcgctcccaggccctggtcgacctgcaccgcagcttccacacctgcatctcccgccagcgcgtcctgccccggatgcaggctcgcatgcgtgggttccaggccagcctgtcttcacacattcctccaacagctgttggctgaccgtctgcctcatctacccttgggccagatgctggaagcggtacctccggcggcgggcagctttgggacagctgaacaccatcctgctggtggcccagcccctgctccagaggcggcagagactgcagcttgggcgttggcagggctggcatagcagcgaaagggccttggagagagtgccaagcatggagctggggcgcttggagatcccggctgagctggccgtcatgctgaagacggcggaaagccatcgggacgccctggctgggagcatcaccgagtgcctgccgcctgaggttcctgcccggcccagcctgactctcccagcagacattgacctgttccctttctccagcttcgtcgccatcggctttcaggaaccgtccctgcccaggccagggcagccactggcgaagcccctaacccagctggatggagacaaccctcagcgtgccctggacatcaacaaagtgatgctgcggctcctgggggacggatccctggagtcctggcagaggcagatcatgggcgcatacctggtgcggcaggggcagtgcnggccagggctgcggaatgagctctttagccagctggtggcccagctatggcagaacccagatgaacagcagagccagcgtggctgggccctcatggctgttttgctcagcgcctttcccccactgcctgtcctacagaagccactgctcaagttcgtgtctgaccaggcccccaggggcatggcagcgctgtgccagcacaagctgctgggggccttggagcagtcgcagctggcctcgggggccactcgggcccaccccccgacccagctggagtggctggccggatggcggcggggccgcatggcgctggatgtgttcaccttcagcgaggagtgctactcggccgaggtggagtcttggaccaccggggagcagctggctgggtggatcctgcagagcagaggcctggaggcgcctccccggggctggtctgtgtcactgcactccagggacgcatggcaggacttggctggctgcgactttgtgctggacctgatcagccagactgaggacctgggggacccagctcgcccccgcagctaccccatcactcctcttggctcagccgaggccattccccttgcccctggcattcaggccccctcactgcccccaggaccccctccaggtccagccccaacgctgcccagcagggaccacacaggggaggtccagaggtcagggagcctggacggcttcctggaccagatcttccagccagtgatatcctccggcctcagcgatctggaacaaagctgggctctgagcagccgcatgaagggagggggcgccattgggcccacacagcagggctaccccatggtgtacccaggaatgattcagatgcctgcataccagccaggcatggtccctgcacccatgcccatgatgccagcaatgggcacagtccctgccatgccagccatggtggtgccgccgcagccaccgcttcccagcctggatgcagggcagctggccgtccagcagcagaactttatccagcagcaggcgctaatcctggcccagcagatgacagcccaggccatgtccctgtccctggagcagcagatgcagcagcggcagcagcaggctcgggcctccgaggctgcgtcccaggcctcaccctcagccgtcacctccaagcccaggaagccccccacacccccggagaagccacagcgtgacctgggatcagagggtggctgcctgagggagacctccgaggaggctgaagacaggccctatcagcccaagagcttccagcagaaacggaactatttccagaggatggggcagccacagatcacagtgaggacgatgaagcccccggccaaggtccacatcccccagggggaagcgcaggaggaggaggaggaggaggaggaggaggaggagcaggaggagcaagaagtggaaacaagagcagtgccgtcccctcctcctccccccatcgtgaagaagccattgaagcaaggtggggccaaagctccaaaagaggctgaggctgagccagccaaggagacagcggccaaggccatggccaagggccagcccaaggcagggggactgtggtgcgcagctcagactccaagcccaagcggccacaacccagcagggaaattggcaacatcatccgcatgtaccagagccgcccgggccccgtgcctgtgcccgtgcagccatccaggcctcccaaagctttcctgaggaaaatcgaccccaaggacgaggctctggccaagctgggtatcaacggtgcccactcgtccccgccgatgctgtcccccagcccaggaaagggccccccgccagctgtggctcctcgacccaaggccccgctacagcttgggccctctagctccatcaaggaaaagcaggggccccttctggacctgtttggccagaagctgcctattgcccacacacccccacctccaccagcgccaccactgcctctgcccgaggacccagggaccctttcagcagagcgtcgttgcttgacacagcccgtggaggaccagggggtctccacccagctactcgcgccctctggcagcgtgtgcttctcctacaccggcacgccctggaagttgttcctacgcaaggaggtgttctacccacgggagaacttcagccatccctactacctgaggctcctctgtgagcagatcctacgggacaccttctccgagtcctgtatccggatttcccagaatgagcggcggaaaatgaaagacctgctgggaggcttggaggtggacctggattctctcaccaccaccgaagacagcgtcaagaagcgcatcgtggtggccgctcgggacaactgggccaattacttctcccgcttctttcctgtctcgaagtcccgggagcgggtatgcctgggagtggccagctggctgcctggctctggcccacagagggcaagtgtggaggaattcccagccctaaggtcttgctggtagctgtgagcaaggatgcagctgctgtaggctgatgtctttcctggtggggcagatggaggtgcagcgccggccctggttagtgaagtacggggacagcggggagcagatagccggtgtcccggtgggaagt

SEQ ID NO: 354344 - DNA, 270 bp, Homo sapiens
ctggccctgggcagctccagggcatcttgggcagtagcaggacccaggagactgcccgagacccaccaccttcctgtagggcgagagtggcagcgacgtgcagctgttagccgtgtcccaccgtgggctgcgactgctcaaggtgacccaaggccccggcctccgccccgaccagctgaagattctctgctcatacaggtgcgctggcccacgaccctgggctagaggtgggggcaggtggcaaggtgaccccagttcatgcccgatccc

SEQ ID NO: 354345 - DNA, 141 bp, Homo sapiens
gacgacaggcgtgagccactgctcccagcctactttatattttcattagctggaaatggaggttcccagaaacatcaagatttgtgacattagctgggcttggtagcatgtgcctctagtcccagctactcaggaggctga

SEQ ID NO: 354346 - DNA, 942 bp, Homo sapiens
tacgggctatgtcgaccaggcgtacccgcacgcgtcggccaaggatctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtgaaactgggt

SEQ ID NO: 354347 - DNA, 2653 bp, Homo sapiens
agcgggtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtgaaactgggt

SEQ ID NO: 354348 - DNA, 2147 bp, Homo sapiens
agcgggtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaagtggcctttttaggtgggtattcttcagccgcctctagaatctctgagcctctctctcgggcctcatatctttctctaggccttggactttgccttcagttatatgcactttaaatcccatcaataaaggaaaaaacaaaacaaaactaacagcctttgtggaaaacta

SEQ ID NO: 354349 - DNA, 2223 bp, Homo sapiens
agcgggtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggaaagaaccttgctacttggtctctgcaatctccttggaaaatagaatgctcctgtagccagaacactctttggaaatgatgtaacgccacagaatatgctcacgaccagcctcagtagtgaaggcttgttataaaacatagatctattcttcatggggaaaaaaagtcatcccaggatataataaaattacacttaagaatgcagcaacccttttaaaaacatattcaacaaaaaaaaagcccctgccattttctgatatcatggtaatactcctaataaatcacaaaatatg

SEQ ID NO: 354350 - DNA, 2696 bp, Homo sapiens
agcgggtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggggactctcggccagtcaccgggcccccgccccaccacccccaccgctgctgctgccactgccgctgctgctgccgctgctggagctgccactgctgcaccggtcctcgtagatggagatctcaatctggggtcggtggttaaggagagctgcgagcccagctgctgagcaggggtgggacatgaaccagcggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtgaaactgggt

SEQ ID NO: 354351 - DNA, 539 bp, Homo sapiens
tgcagacagacaggtctattggacagcattgctccagagaggagggacctcaaatctgtcttgttcaccatttccctagcacttagaacagtgctcaattcatgcttttattcaatggatgaattagttgatgctgatgcttccgctgagagcctcctgctctcctctgctgctgatgctctctccttctgcccctcagggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaaggtagagccgagagacaaggtagagccgagagacaaggtagagccgagagacaaggtagagccgagagacaaggtagagccgagagacaaggtagagccgagggg

SEQ ID NO: 354352 - DNA, 2007 bp, Homo sapiens
agcgggtataaagcgagcgcgcggcgtcggggcgggaggctcgaggccagcccgggaccggggctgggagcaagcaggcggcggcgccggcggcagaggcggcagcgagcgcccgcttcccacgcccctaggcggcggggccgagagcgggaggatggctccgagcgctgaccccggcatgtccaggatgttaccgttcctgctgctgctctggtttctgcccatcactgaggggtcccagcgggctgaacccatgttcactgcagtcaccaactcagttctgcctcctgactatgacagtaatcccacccagctcaactatggtgtggcagttactgatgtggaccatgatggggactttgagatcgtcgtggcggggtacaatggacccaacctggttctgaagtatgaccgggcccagaagcggctggtgaacatcgcggtcgatgagcgcagctcaccctactacgcgctgcgggaccggcaggggaacgccatcggggtcacagcctgcgacatcgacggggacggccgggaggagatctacttcctcaacaccaataatgccttctcgggggtggccacgtacaccgacaagttgttcaagttccgcaataaccggtgggaagacatcctgagcgatgaggtcaacgtggcccgtggtgtggccagcctctttgccggacgctctgtggcctgtgtggacagaaagggctctggacgctactctatctacattgccaattacgcctacggtaatgtgggccctgatgccctcattgaaatggaccctgaggccagtgacctctcccggggcattctggcgctcagagatgtggctgctgaggctggggtcagcaaatatacagggggccgaggcgtcagcgtgggccccatcctcagcagcagtgcctcggatatcttctgcgacaatgagaatgggcctaacttccttttccacaaccggggcgatggcacctttgtggacgctgcggccagtgctggtgtggacgacccccaccagcatgggcgaggtgtcgccctggctgacttcaaccgtgatggcaaagtggacatcgtctatggcaactggaatggcccccaccgcctctatctgcaaatgagcacccatgggaaggtccgcttccgggacatcgcctcacccaagttctccatgccctcccctgtccgcacggtcatcaccgccgactttgacaatgaccaggagctggagatcttcttcaacaacattgcctaccgcagctcctcagccaaccgcctcttccgcgtcatccgtagagagcacggagaccccctcatcgaggagctcaatcccggcgacgccttggagcctgagggccggggcacagggggtgtggtgaccgacttcgacggagacgggatgctggacctcatcttgtcccatggagagtccatggctcagccgctgtccgtcttccggggcaatcagggcttcaacaacaactggctgcgagtggtgccacgcacccggtttggggcctttgccaggggagctaaggtcgtgctctacaccaagaagagtggggcccacctgaggatcatcgacgggggctcaggctacctgtgtgagatggagcccgtggcacactttggcctggggaaggatgaagccagcagtgtggaggtgacgtggccagatggcaagatggtgagccggaacgtggccagcggggagatgaactcagtgctggagatcctctacccccgggatgaggacacacttcaggacccagccccactggagtgtggccaaggattctcccagcaggaaaatggccattgcatggacaccaatgaatgcatccagttcccattcgtgtgccctcgagacaagcccgtatgtgtcaacacctatggaagctacaggtgccggaccaacaagaagtgcagtcggggctacgagcccaacgaggatggcacagcctgcgtggctcaggtggcatcgataaacaccgggtaccgagc

SEQ ID NO: 354353 - DNA, 369 bp, Homo sapiens
caaagtgccaaggaatgattctgcagtgtgttcaacgcttatcttagaccagtctctgaatgacagctatgaacaccatagcaacccttccttgccagttttaaaatacatggtgtgggctccttttctctgagtaggttctggaaagatgaattaagggattcaccatgcaaaaatgtagactggaggcaggaggaacttttttgcatcagctggacaaacccagaatttgtccttttcttctctggagcaggcttcctgtctctggagtttaaactcacaagttaagtctgcacataatttatgggagtaagataagtgcatctgtgaggttattcagatcaatgaatgttttgcagtatttgggtg

SEQ ID NO: 354354 - DNA, 444 bp, Homo sapiens
cttttgctatttatttgtccttaagctgtctttccaattccagattgtcctgggtatttgccacaaaaaagaaagcatgtacattatcctatcgttcatttaagtaaatggtaataaaatattttaaggggctattaatatttaaaatccttttctactatggcaaaaatctacagagaaactgaactggcaaaattaactacctggagcaaaacagatgtgcagatctaactaaaacagagctatagtgaaacaaaatgagattgtaagaagacattaaagctattgatttgatttttccatagcaagcaccaaaagcttatattcacagttcctgtgtttcatattagacttatagctgaattggtattttgctgaaaattcctagaaaactgcttgatgacaataaaaagtaaataaaagcactgctaccttctttgattg

SEQ ID NO: 354355 - DNA, 371 bp, Homo sapiens
tttttttttctgtttttgttcttttctttgccctcatattttctcttataaaaccacatagattttaattttttcatccaagttaacaatctctgtgttttaacagatacatttagttcattaacattttttagggtttatttctgccatcttagtttgagctttgtgtttactttgctatatatgatctttgctttcttttttccaaacttttagtgggattgattctgatttctttatttcctcttttcctgttctactgatttggtaattatcagtcttatttgtatttctgtatatacatacagatgttttagatgttacccttacatttttaacacacatacttgactttgaaaagtacaaaatgt

SEQ ID NO: 354356 - DNA, 1691 bp, Homo sapiens
  misc_feature (23)..(24): n is a, c, g, or t
  misc_feature (1335)..(1335): n is a, c, g, or t
aacctacggctaggtacgaggcnnggtgttacagaggccttctctgagggcaagaggaggagaggagaaatagagtaaggcaggcagaggaaacagtctgagctaagaccctgtggctagaagtggcagagggagaggcagcaggaaggccagcggggaggctggggcccagtgcaggcccaggttggaggagcgtagcacatggagtttggtaggagtttgggacgccctggtggatcttaattgtgatggggtgggtgtgaaaggcagtccaggttgcactggttgcacaggagaagtgatcagaagaggaccccagcaggtgtgagccgtgagctgggaggtgcttcagtagtgcaggccatagctgaaggtgtcctacatcagcagggtgatggtgaggtttgaaccactgtttcactgcatagtccctgctgatggacacttgagtgttcagattttttgctggtatattcagtgctgcagtggacattttcatacaaaatatttcggtacacttttgtttatatctgaaaggtaaattcctagcagtagaattattagagcaaacggaatttaacattttggtgtgtattgccaaattgccctcccaagtggtttagtcagcttacccttgccaacaatagatctatccttgccagccttgggcatcacatttaccagtttaatagattgtaaaaccatatcttaattggctaccctgaagccaccatactggagaggctgcgtacagtgtttcacgtagagagagggatacccaggaggcccacctgctccaaccccagctgcatgagtcttcccagcccaggcacagacatgtggataagatttaaacatttccagccccagccttcaagcaatcctagttgacactgaggggagccaacataagctgagctgagaaacagtctgcccagtctgcagattcatgagcaaaagaaatgttgggctgggtacagtggctcacgcctgtaatcccagtactttgggaggccgaggtgggtggatcagttgaggtcaggagtttgagaccagcctggccaacatggtgaagccctgtctctactaaaaattagccgagtgtggtggtgcgggcctgtaatcccagctactcaggtggctgaggcaggagaatggcttgaacccgggaggcggaggttgcagtgagccaagatcaggccactgcactccagcctggatgacgggatgagactctgtctcaaaaaaacgaaacaaaaattttttaagagaaatgtcatttgtttttgtttttgagacagggtctcactctgttgccctcactagagtgcagtnggatcacggctcactgaagtctctacctaccggctcaattgatcttcccaccacagcctcccaaatagctgggagaaatgtcctgtttttaatgaatttgtcttcctttttgtcttgtttgttttaatatctagtgatctaataaatttggatgatatcttttgactatcaattatgaaacctgtatcagatatacacatctttccttcttcatcctcaggctttctggttttgatggtgatactgtggcttttgtacttctggtggtttcccttatactgttaaacctcttttttttttttaaattaaaccaacttagtatgcattaaccactgaacaagggaaaggaactcaca

SEQ ID NO: 354357 - DNA, 518 bp, Homo sapiens
tttcgaagaagatataaaatatgattagttctgtggctgtgaatgttataattaaggagagaacgacccaccatctgttgggtagataccacagccgggtcttcgcatgatccccctgtctgcagttagcagagctgtcatgctgtgtggccgtggaatgatctccagatttcatgtgatgccaatgaagtacaggaaaaactggactcccagaaaccaccacaaagtaatcactctcccatctctgcttggtacctttgattcttccacaagcacatctcaggcagccaaaaagattgtgttgaattttatgttctgtgggtttctttccaaaataatagatatggagtttgcaatctcccccgtgagaagaatatgttttgggaagaatgggagtcatatggaagtgacttgaacccaactctcagcctggagtcaggctcagtctagagaagctgatccctagacaacctgcagatacatgagtaagaaataaagacctgtcatgaagttttaag

SEQ ID NO: 354358 - DNA, 542 bp, Homo sapiens
aggagtacttagagagtgtccggccagcaaaatattttcaattagcttaaatagacacctagacagaacaaataaatgtcttggtgatgtctgctccagaaggcccactggtctctgtggagtggtgggagcattagaaactgaagggggaacgcgtggtgtagtccctaaggaacagaagaatcttgcccgctggccacactagggctccacccaggcctcattctttccgctttgttccttgggacctttcgagtgtggacgagctgggcagcttgctgctaagctcaagggctaggatttttgtccaacaaccaagtgtcctcttgagtccttcatagcctcttatcatgacccactctaagccattggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatgga

SEQ ID NO: 354359 - DNA, 4409 bp, Homo sapiens
  misc_feature (23)..(24): n is a, c, g, or t
  misc_feature (4053)..(4053): n is a, c, g, or t
aacctacggctaggtacgaggcnnggtgttaggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggagagagcgccacaccctggtggcataaacgagtccctgaatcatgccgtggctgaaccaagccctgtctgtgggctttttctgttgtactcagggcagtttgatggggttactgtcctgcatagccataatggcccagtataaagcagctgttttgatgagataattgctttaattaagcaaaaggtagcaaagctttcactccgccctgtaccttctgtttccacttaggagccttcccatgtcagaatgtgcagatctgtctcattgtttcctgtgcagtgtgcccccacttcacccagtagtttctgtgtgtctgttatgtactaggtactacaaggtgccaggacggtgtagatacagcctctgctatcgtaaaactcaatgattcggtgggggaagacaaatgtcagtaatgtacaaagtaaaatggcagctgttagaagtatgaaaggggcagggtagggggaggtagaatcttccctgaccaggttaagaaaaccagaggccttctctgagggcaagaggaggagaggagaaatagagtaaggcaggcagaggaaacagtctgagctaagaccctgtggctagaagtggcagagggagaggcagcaggaaggccagcggggaggctggggcccagtgcaggcccaggttggaggagcgtagcacatggagtttggtaggagtttgggacgccctggtggatcttaattgtgatggggtgggtgtgaaaggcagtccaggttgcactggttgcacaggagaagtgatcagaagaggaccccagcaggtgtgagccgtgagctgggaggtgcttcagtagtgcaggccatagctgaaggtgtcctacatcagcagggtgatggtgaggtttgaaccactgtttcactgcatagtccctgctgatggacacttgagtgttcagattttttgctggtatattcagtgctgcagtggacattttcatacaaaatatttcggtacacttttgtttatatctgaaaggtaaattcctagcagtagaattattagagcaaacggaatttaacattttggtgtgtattgccaaattgccctcccaagtggtttagtcagcttacccttgccaacaatagatctatccttgccagccttgggcatcacatttaccagtttaatagattgtaaaaccatatcttaattggctaccctgaagccaccatactggagaggctgcgtacagtgtttcacgtagagagagggatacccaggaggcccacctgctccaaccccagctgcatgagtcttcccagcccaggcacagacatgtggataagatttaaacatttccagccccagccttcaagcaatcctagttgacactgaggggagccaacataagctgagctgagaaacagtctgcccagtctgcagattcatgagcaaaagaaatgttgggctgggtacagtggctcacgcctgtaatcccagtactttgggaggccgaggtgggtggatcagttgaggtcaggagtttgagaccagcctggccaacatggtgaagccctgtctctactaaaaattagccgagtgtggtggtgcgggcctgtaatcccagctactcaggtggctgaggcaggagaatggcttgaacccgggaggcggaggttgcagtgagccaagatcaggccactgcactccagcctggatgacgggatgagactctgtctcaaaaaaacgaaacaaaaattttttaagagaaatgtcatttgtttttgtttttgagacagggtctcactctgttgccctcactagagtgcagtnggatcacggctcactgaagtctctacctaccggctcaattgatcttcccaccacagcctcccaaatagctgggagaaatgtcctgtttttaatgaatttgtcttcctttttgtcttgtttgttttaatatctagtgatctaataaatttggatgatatcttttgactatcaattatgaaacctgtatcagatatacacatctttccttcttcatcctcaggctttctggttttgatggtgatactgtggcttttgtacttctggtggtttcccttatactgttaaacctcttttttttttttaaattaaaccaacttagtatgcattaaccactgaacaagggaaaggaactcaca

SEQ ID NO: 354360 - DNA, 1798 bp, Homo sapiens
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacatta

SEQ ID NO: 354361 - DNA, 1609 bp, Homo sapiens
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttgacccctgagccccttccagtgctgcctgaggtgccctctacctgtgcctgcctctcgtctgccagtttgatttggacctgtttttcccacctcagcccccatgctcttgtcaaacgtgtttggctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaaggtaggatcttgacatatgactagctcttgggaataaggccatggaagtaaggcagacacatggggtgatttcatcagccttattatccttagataactgtttatcttaggttatccttagataagttattatccctagataaaatgaagcccattttaatagaaatgaaacaacacatttcaactcggggtcctctgtcg

SEQ ID NO: 354362 - DNA, 4140 bp, Homo sapiens
  misc_feature (7)..(7): n is a, c, g, or t
  misc_feature (3784)..(3784): n is a, c, g, or t
gcttccncctcctttgccggggtacacctggcccacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggagagagcgccacaccctggtggcataaacgagtccctgaatcatgccgtggctgaaccaagccctgtctgtgggctttttctgttgtactcagggcagtttgatggggttactgtcctgcatagccataatggcccagtataaagcagctgttttgatgagataattgctttaattaagcaaaaggtagcaaagctttcactccgccctgtaccttctgtttccacttaggagccttcccatgtcagaatgtgcagatctgtctcattgtttcctgtgcagtgtgcccccacttcacccagtagtttctgtgtgtctgttatgtactaggtactacaaggtgccaggacggtgtagatacagcctctgctatcgtaaaactcaatgattcggtgggggaagacaaatgtcagtaatgtacaaagtaaaatggcagctgttagaagtatgaaaggggcagggtagggggaggtagaatcttccctgaccaggttaagaaaaccagaggccttctctgagggcaagaggaggagaggagaaatagagtaaggcaggcagaggaaacagtctgagctaagaccctgtggctagaagtggcagagggagaggcagcaggaaggccagcggggaggctggggcccagtgcaggcccaggttggaggagcgtagcacatggagtttggtaggagtttgggacgccctggtggatcttaattgtgatggggtgggtgtgaaaggcagtccaggttgcactggttgcacaggagaagtgatcagaagaggaccccagcaggtgtgagccgtgagctgggaggtgcttcagtagtgcaggccatagctgaaggtgtcctacatcagcagggtgatggtgaggtttgaaccactgtttcactgcatagtccctgctgatggacacttgagtgttcagattttttgctggtatattcagtgctgcagtggacattttcatacaaaatatttcggtacacttttgtttatatctgaaaggtaaattcctagcagtagaattattagagcaaacggaatttaacattttggtgtgtattgccaaattgccctcccaagtggtttagtcagcttacccttgccaacaatagatctatccttgccagccttgggcatcacatttaccagtttaatagattgtaaaaccatatcttaattggctaccctgaagccaccatactggagaggctgcgtacagtgtttcacgtagagagagggatacccaggaggcccacctgctccaaccccagctgcatgagtcttcccagcccaggcacagacatgtggataagatttaaacatttccagccccagccttcaagcaatcctagttgacactgaggggagccaacataagctgagctgagaaacagtctgcccagtctgcagattcatgagcaaaagaaatgttgggctgggtacagtggctcacgcctgtaatcccagtactttgggaggccgaggtgggtggatcagttgaggtcaggagtttgagaccagcctggccaacatggtgaagccctgtctctactaaaaattagccgagtgtggtggtgcgggcctgtaatcccagctactcaggtggctgaggcaggagaatggcttgaacccgggaggcggaggttgcagtgagccaagatcaggccactgcactccagcctggatgacgggatgagactctgtctcaaaaaaacgaaacaaaaattttttaagagaaatgtcatttgtttttgtttttgagacagggtctcactctgttgccctcactagagtgcagtnggatcacggctcactgaagtctctacctaccggctcaattgatcttcccaccacagcctcccaaatagctgggagaaatgtcctgtttttaatgaatttgtcttcctttttgtcttgtttgttttaatatctagtgatctaataaatttggatgatatcttttgactatcaattatgaaacctgtatcagatatacacatctttccttcttcatcctcaggctttctggttttgatggtgatactgtggcttttgtacttctggtggtttcccttatactgttaaacctcttttttttttttaaattaaaccaacttagtatgcattaaccactgaacaagggaaaggaactcaca

SEQ ID NO: 354363 - DNA, 2259 bp, Homo sapiens
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttgacccctgagccccttccagtgctgcctgaggtgccctctacctgtgcctgcctctcgtctgccagtttgatttggacctgtttttcccacctcagcccccatgctcttgtcaaacgtgtttggctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaagggatgggcacaacttggaagattttggctttgtgatcctcagtgtccagtgtcacccagatgggccggaagctgcctttgaagccaacgaatgccatttgctctgaaaagcaatgatgagtctcctgagcaaaagccctatgagaggacggctgccccaccccgttccatggctccccatcgccagccccccacgcccaccagcacttgctctgaaggaacacttggttcatcagaagaaaaaaagcccattgttgtcaccatctcaaatctgttgggtagataccacagccgggtcttcgcatgatccccctgtctgcagttagcagagctgtcatgctgtgtggccgtggaatgatctccagatttcatgtgatgccaatgaagtacaggaaaaactggactcccagaaaccaccacaaagtaatcactctcccatctctgcttggtacctttgaaaggccttaagggaaatgcaaacagtcctgtagaatgaaatctgggagcaatgaggaagaaggacccagggagatcgtgtccgtgtctgcagccagcctggggaagagaagcctaagagatagctgtgtccctagattcttccacaagcacatctcaggcagccaaaaagattgtgttgaattttatgttctgtgggtttctttccaaaataatagatatggagtttgcaatctcccccgtgagaagaatatgttttgggaagaatgggagtcatatggaagtgacttgaacccaactctcagcctggagtcaggctcagtctagagaagctgatccctagacaacctgcagatacatgagtaagaaataaagacctgtcatgaagttttaag

SEQ ID NO: 354364 - DNA, 4070 bp, Homo sapiens
  misc_feature (3714)..(3714): n is a, c, g, or t
tacatgagatatcagtagctgctaggctttggaaaatccaatttttcattccatattcatgtagaatttgaaataaactgataagtgccagagaattgctctgaccccttagcaccttactagtacgtgctggctgactgattgcatctctctgcccaaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggagagagcgccacaccctggtggcataaacgagtccctgaatcatgccgtggctgaaccaagccctgtctgtgggctttttctgttgtactcagggcagtttgatggggttactgtcctgcatagccataatggcccagtataaagcagctgttttgatgagataattgctttaattaagcaaaaggtagcaaagctttcactccgccctgtaccttctgtttccacttaggagccttcccatgtcagaatgtgcagatctgtctcattgtttcctgtgcagtgtgcccccacttcacccagtagtttctgtgtgtctgttatgtactaggtactacaaggtgccaggacggtgtagatacagcctctgctatcgtaaaactcaatgattcggtgggggaagacaaatgtcagtaatgtacaaagtaaaatggcagctgttagaagtatgaaaggggcagggtagggggaggtagaatcttccctgaccaggttaagaaaaccagaggccttctctgagggcaagaggaggagaggagaaatagagtaaggcaggcagaggaaacagtctgagctaagaccctgtggctagaagtggcagagggagaggcagcaggaaggccagcggggaggctggggcccagtgcaggcccaggttggaggagcgtagcacatggagtttggtaggagtttgggacgccctggtggatcttaattgtgatggggtgggtgtgaaaggcagtccaggttgcactggttgcacaggagaagtgatcagaagaggaccccagcaggtgtgagccgtgagctgggaggtgcttcagtagtgcaggccatagctgaaggtgtcctacatcagcagggtgatggtgaggtttgaaccactgtttcactgcatagtccctgctgatggacacttgagtgttcagattttttgctggtatattcagtgctgcagtggacattttcatacaaaatatttcggtacacttttgtttatatctgaaaggtaaattcctagcagtagaattattagagcaaacggaatttaacattttggtgtgtattgccaaattgccctcccaagtggtttagtcagcttacccttgccaacaatagatctatccttgccagccttgggcatcacatttaccagtttaatagattgtaaaaccatatcttaattggctaccctgaagccaccatactggagaggctgcgtacagtgtttcacgtagagagagggatacccaggaggcccacctgctccaaccccagctgcatgagtcttcccagcccaggcacagacatgtggataagatttaaacatttccagccccagccttcaagcaatcctagttgacactgaggggagccaacataagctgagctgagaaacagtctgcccagtctgcagattcatgagcaaaagaaatgttgggctgggtacagtggctcacgcctgtaatcccagtactttgggaggccgaggtgggtggatcagttgaggtcaggagtttgagaccagcctggccaacatggtgaagccctgtctctactaaaaattagccgagtgtggtggtgcgggcctgtaatcccagctactcaggtggctgaggcaggagaatggcttgaacccgggaggcggaggttgcagtgagccaagatcaggccactgcactccagcctggatgacgggatgagactctgtctcaaaaaaacgaaacaaaaattttttaagagaaatgtcatttgtttttgtttttgagacagggtctcactctgttgccctcactagagtgcagtnggatcacggctcactgaagtctctacctaccggctcaattgatcttcccaccacagcctcccaaatagctgggagaaatgtcctgtttttaatgaatttgtcttcctttttgtcttgtttgttttaatatctagtgatctaataaatttggatgatatcttttgactatcaattatgaaacctgtatcagatatacacatctttccttcttcatcctcaggctttctggttttgatggtgatactgtggcttttgtacttctggtggtttcccttatactgttaaacctcttttttttttttaaattaaaccaacttagtatgcattaaccactgaacaagggaaaggaactcaca

SEQ ID NO: 354365 - DNA, 3823 bp, Homo sapiens
  misc_feature (3467)..(3467): n is a, c, g, or t
gacgttcccatggtagaaaagaagagcaagaaacccaagagagaaagagaaaaaacacaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggagagagcgccacaccctggtggcataaacgagtccctgaatcatgccgtggctgaaccaagccctgtctgtgggctttttctgttgtactcagggcagtttgatggggttactgtcctgcatagccataatggcccagtataaagcagctgttttgatgagataattgctttaattaagcaaaaggtagcaaagctttcactccgccctgtaccttctgtttccacttaggagccttcccatgtcagaatgtgcagatctgtctcattgtttcctgtgcagtgtgcccccacttcacccagtagtttctgtgtgtctgttatgtactaggtactacaaggtgccaggacggtgtagatacagcctctgctatcgtaaaactcaatgattcggtgggggaagacaaatgtcagtaatgtacaaagtaaaatggcagctgttagaagtatgaaaggggcagggtagggggaggtagaatcttccctgaccaggttaagaaaaccagaggccttctctgagggcaagaggaggagaggagaaatagagtaaggcaggcagaggaaacagtctgagctaagaccctgtggctagaagtggcagagggagaggcagcaggaaggccagcggggaggctggggcccagtgcaggcccaggttggaggagcgtagcacatggagtttggtaggagtttgggacgccctggtggatcttaattgtgatggggtgggtgtgaaaggcagtccaggttgcactggttgcacaggagaagtgatcagaagaggaccccagcaggtgtgagccgtgagctgggaggtgcttcagtagtgcaggccatagctgaaggtgtcctacatcagcagggtgatggtgaggtttgaaccactgtttcactgcatagtccctgctgatggacacttgagtgttcagattttttgctggtatattcagtgctgcagtggacattttcatacaaaatatttcggtacacttttgtttatatctgaaaggtaaattcctagcagtagaattattagagcaaacggaatttaacattttggtgtgtattgccaaattgccctcccaagtggtttagtcagcttacccttgccaacaatagatctatccttgccagccttgggcatcacatttaccagtttaatagattgtaaaaccatatcttaattggctaccctgaagccaccatactggagaggctgcgtacagtgtttcacgtagagagagggatacccaggaggcccacctgctccaaccccagctgcatgagtcttcccagcccaggcacagacatgtggataagatttaaacatttccagccccagccttcaagcaatcctagttgacactgaggggagccaacataagctgagctgagaaacagtctgcccagtctgcagattcatgagcaaaagaaatgttgggctgggtacagtggctcacgcctgtaatcccagtactttgggaggccgaggtgggtggatcagttgaggtcaggagtttgagaccagcctggccaacatggtgaagccctgtctctactaaaaattagccgagtgtggtggtgcgggcctgtaatcccagctactcaggtggctgaggcaggagaatggcttgaacccgggaggcggaggttgcagtgagccaagatcaggccactgcactccagcctggatgacgggatgagactctgtctcaaaaaaacgaaacaaaaattttttaagagaaatgtcatttgtttttgtttttgagacagggtctcactctgttgccctcactagagtgcagtnggatcacggctcactgaagtctctacctaccggctcaattgatcttcccaccacagcctcccaaatagctgggagaaatgtcctgtttttaatgaatttgtcttcctttttgtcttgtttgttttaatatctagtgatctaataaatttggatgatatcttttgactatcaattatgaaacctgtatcagatatacacatctttccttcttcatcctcaggctttctggttttgatggtgatactgtggcttttgtacttctggtggtttcccttatactgttaaacctcttttttttttttaaattaaaccaacttagtatgcattaaccactgaacaagggaaaggaactcaca

SEQ ID NO: 354366 - DNA, 443 bp, Homo sapiens
atagacggacgagattgaaatgtgtttggctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaaggtaggatcttgacatatgactagctcttgggaataaggccatggaagtaaggcagacacatggggtgatttcatcagccttattatccttagataactgtttatcttaggttatccttagataagttattatccctagataaaatgaagcccattttaatagaaatgaaacaacacatttcaactcggggtcctctgtcg

SEQ ID NO: 354367 - DNA, 829 bp, Homo sapiens
  misc_feature (767)..(767): n is a, c, g, or t
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctggatacnaacagaccgtcagggcacatgacgcgtgttggggcagtgaccgtcactcatgcccacaggta

SEQ ID NO: 354368 - DNA, 684 bp, Homo sapiens
  misc_feature (23)..(24): n is a, c, g, or t
aacctacggctaggtacgaggcnnggtgttaggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggctggagtgcagcggcgtgatctcggctcactgcaacctccgcctccctggttcaagcgattctcctgcctcagcctcccgagtagctggaactacaggcgcccgccaccatgcctggctaattttgtatttttagtagagacagggtttcaccatgttggccaggctggtcttgaatttctgac

SEQ ID NO: 354369 - DNA, 2980 bp, Homo sapiens
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttgacccctgagccccttccagtgctgcctgaggtgccctctacctgtgcctgcctctcgtctgccagtttgatttggacctgtttttcccacctcagcccccatgctcttgtcaaacgtgtttggctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaagggatgggcacaacttggaagattttggctttgtgatcctcagtgtccagtgtcacccagatgggccggaagctgcctttgaagccaacgaatgccatttgctctgaaaagcaatgatgagtctcctgagcaaaagccctatgagaggacggctgccccaccccgttccatggctccccatcgccagccccccacgcccaccaggtaccgcctagccacactgcactgtggccccttgggaagagctctgtgctcagctactgatggtgcctgacatgtgtttgtatggggcaggcagggtctcacctgagcctcactgccacctaggcagggtgatggctttgttgtagacaggggagccatgcacagcaggaaatggggcaaactgtaagggaggagacctcctaggaacctgcctaccttcgagctgcccctaggacaaccagcaagtccctgcccctctctgaagcccagtgttcccatccatcaaatgatggcattgatctacaagatctccttccccactctatcactctgtggctctagaaagagttctgagaggtgaagaaatctgaccaagagtgtggagtaaatggtgcaccccagattagaactctaaacccctgaaacccacacagcactctccatcttgcagttcacagcttgagcatccgaggggcatgggaatccacgtctatactcagcccatcttggcaggcaacatgcatttatcaccaccgggaaagtgccattcaacttaggtcaccttacatacatcagcttttggcaaccgggatcttaatttaaaagacagaggctccaaaatgatttcaggactgggctggaaaggatacttctcttttccttatgtcctcctttggctggtttgaagggtttgcattgcttctgatttttctcattgccccatatgatgggtttctgattttgatgttttccatagtgaggatggtgtataactaagaagcccagctttgagttaggaagattaggatccaagtcctaaccttaagcaagtggcttggctgttaaattcttggtgtcctcatcttaaatggaaataatagtacctgctgcacaggttattaatgagtaagtgagataattataacatgttgtgcaaagtgcaaggctgaacattgaatagcaaccacaatgatcattatcattattgcccgtggagcttctctgccgcccatacagcctctctgaggactctccctgcacctagtttttgtgatgataatgggtgtcatgctgacatgtccctcctggatggcttcttccagcacagccagcaagcctgtgctaggcttcaccaccgaagctgcctggccttggacaagccatgtaggttctctgggctttagttttctggaacaaataagagttttgcaagctgcaaaggactgtacaaacgctaggcatcagctagaatgttgaagaagatgcaggacccctggccagtctgaatagcaggaattgggtaggagggtgagactaagccacttttcttatgatacttttgttgaataaagggccactttccaagca

SEQ ID NO: 354370 - DNA, 4435 bp, Homo sapiens
  misc_feature (4079)..(4079): n is a, c, g, or t
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggagagagcgccacaccctggtggcataaacgagtccctgaatcatgccgtggctgaaccaagccctgtctgtgggctttttctgttgtactcagggcagtttgatggggttactgtcctgcatagccataatggcccagtataaagcagctgttttgatgagataattgctttaattaagcaaaaggtagcaaagctttcactccgccctgtaccttctgtttccacttaggagccttcccatgtcagaatgtgcagatctgtctcattgtttcctgtgcagtgtgcccccacttcacccagtagtttctgtgtgtctgttatgtactaggtactacaaggtgccaggacggtgtagatacagcctctgctatcgtaaaactcaatgattcggtgggggaagacaaatgtcagtaatgtacaaagtaaaatggcagctgttagaagtatgaaaggggcagggtagggggaggtagaatcttccctgaccaggttaagaaaaccagaggccttctctgagggcaagaggaggagaggagaaatagagtaaggcaggcagaggaaacagtctgagctaagaccctgtggctagaagtggcagagggagaggcagcaggaaggccagcggggaggctggggcccagtgcaggcccaggttggaggagcgtagcacatggagtttggtaggagtttgggacgccctggtggatcttaattgtgatggggtgggtgtgaaaggcagtccaggttgcactggttgcacaggagaagtgatcagaagaggaccccagcaggtgtgagccgtgagctgggaggtgcttcagtagtgcaggccatagctgaaggtgtcctacatcagcagggtgatggtgaggtttgaaccactgtttcactgcatagtccctgctgatggacacttgagtgttcagattttttgctggtatattcagtgctgcagtggacattttcatacaaaatatttcggtacacttttgtttatatctgaaaggtaaattcctagcagtagaattattagagcaaacggaatttaacattttggtgtgtattgccaaattgccctcccaagtggtttagtcagcttacccttgccaacaatagatctatccttgccagccttgggcatcacatttaccagtttaatagattgtaaaaccatatcttaattggctaccctgaagccaccatactggagaggctgcgtacagtgtttcacgtagagagagggatacccaggaggcccacctgctccaaccccagctgcatgagtcttcccagcccaggcacagacatgtggataagatttaaacatttccagccccagccttcaagcaatcctagttgacactgaggggagccaacataagctgagctgagaaacagtctgcccagtctgcagattcatgagcaaaagaaatgttgggctgggtacagtggctcacgcctgtaatcccagtactttgggaggccgaggtgggtggatcagttgaggtcaggagtttgagaccagcctggccaacatggtgaagccctgtctctactaaaaattagccgagtgtggtggtgcgggcctgtaatcccagctactcaggtggctgaggcaggagaatggcttgaacccgggaggcggaggttgcagtgagccaagatcaggccactgcactccagcctggatgacgggatgagactctgtctcaaaaaaacgaaacaaaaattttttaagagaaatgtcatttgtttttgtttttgagacagggtctcactctgttgccctcactagagtgcagtnggatcacggctcactgaagtctctacctaccggctcaattgatcttcccaccacagcctcccaaatagctgggagaaatgtcctgtttttaatgaatttgtcttcctttttgtcttgtttgttttaatatctagtgatctaataaatttggatgatatcttttgactatcaattatgaaacctgtatcagatatacacatctttccttcttcatcctcaggctttctggttttgatggtgatactgtggcttttgtacttctggtggtttcccttatactgttaaacctcttttttttttttaaattaaaccaacttagtatgcattaaccactgaacaagggaaaggaactcaca

SEQ ID NO: 354371 - DNA, 1954 bp, Homo sapiens
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattaaaaaaaaaaaaaagggggggggggcgcttattatttctcagggccccgttcgtgttccccctttgttaaggggccctgggcattatttgtctccccccaaaccctcccgggacacacactgcttcgaaacctctggagacagaacccgtatcgccg

SEQ ID NO: 354372 - DNA, 1602 bp, Homo sapiens
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttgacccctgagccccttccagtgctgcctgaggtgccctctacctgtgcctgcctctcgtctgccagtttgatttggacctgtttttcccacctcagcccccatgctcttgtcaaacgtgtttggctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaaggtaggatcttgacatatgactagctcttgggaataaggccatggaagtaaggcagacacatggggtgatttcatcagccttattatccttagataactgtttatcttaggttatccttagataagttattatccctagataaaatgaagcccattttaatagaaatgaaacaaacacatttcagatgatgaca

SEQ ID NO: 354373 - DNA, 2123 bp, Homo sapiens
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatggaaatgtgactgtgttgctttttcccatttacacttgacccctgagccccttccagtgctgcctgaggtgccctctacctgtgcctgcctctcgtctgccagtttgatttggacctgtttttcccacctcagcccccatgctcttgtcaaacgtgtttggctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaagggatgggcacaacttggaagattttggctttgtgatcctcagtgtccagtgtcacccagatgggccggaagctgcctttgaagccaacgaatgccatttgctctgaaaagcaatgatgagtctcctgagcaaaagccctatgagaggacggctgccccaccccgttccatggctccccatcgccagccccccacgcccaccagcacttgctctgaaggaacacttggttcatcagaagaaaaaaagcccattgttgtcaccatctcaaatctgttgggtagataccacagccgggtcttcgcatgatccccctgtctgcagttagcagagctgtcatgctgtgtggccgtggaatgatctccagatttcatgtgatgccaatgaagtacaggaaaaactggactcccagaaaccaccacaaagtaatcactctcccatctctgcttggtacctttgattcttccacaagcacatctcaggcagccaaaaagattgtgttgaattttatgttctgtgggtttctttccaaaataatagatatggagtttgcaatctcccccgtgagaagaatatgttttgggaagaatgggagtcatatggaagtgacttgaacccaactctcagcctggagtcaggctcagtctagagaagctgatccctagacaacctgcagatacatgagtaagaaataaagacctgtcatgaagttttaag

SEQ ID NO: 354374 - DNA, 1037 bp, Homo sapiens
caggaaggcgtgtgcaaggcggggtccggcccgcgcaggtcgggtaagcgcgtctagggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagaaagatgatgacattgaagaaggagatcttccagagcacaagagaccttcagcacctgtcgacttctcaaagatagacccaagcaagcctgaaagcatattgaaaatgacgaaaaaagggaagactctcatgatgtttgtcactgtatcaggaagccctactgagaaggagacagaggaaattacgagcctctggcagggcagccttttcaatgccaactatgacgtccagaggttcattgtgggatcagaccgtgctatcttcatgcttcgcgatgggagctacgcctgggagatcaaggactttttggtcggtcaagacaggtgtgctgatgtaactctggagggccaggtgtaccccggcaaaggaggaggaagcaaagagaaaaataaaacaaagcaagacaagggcaaaaaaaagaaggaaggagatctgaaatctcggtcttccaaggaagaaaatcgagctgggaataaaagagaagacctgtgatggggcagcagtgacgcgctgtggggggacaggtggacgtggagagctctttgcccagctcctggggtgggagtggtctcaggcaactgcacaccggatgacattctagtgtcttctagaaagggtctgccacatgaccagtttgtggtcaaagaattactgcttaataggcttcaagtaagaagacagatgttttctaattaatactggacactgacaaattcatgtttactataaaatctccttacatgga

SEQ ID NO: 354375 - DNA, 2174 bp, Homo sapiens
  misc_feature (23)..(24): n is a, c, g, or t
aacctacggctaggtacgaggcnnggtgttaggcgctgcgcggcgcagcgaaaatggcggcttccaggtgggcgcgcaaggccgtggtcctgctttgtgcctctgacctgctgctgctgctgctactgctaccaccgcctgggtcctgcgcggccgaaggctcgcccgggacgcccgacgagtctaccccacctccccggaagaagaagaaggatattcgcgattacaatgatgcagacatggcgcgtcttctggagcaatgggagacccctgagccccttccagtgctgcctgaggtgccctctacctgtgcctgcctctcgtctgccagtttgatttggacctgtttttcccacctcagcccccatgctcttgtcaaacgtgtttggctccagccaaacagggcctgggaggaaaagagagtcctgcttctgcctggcttccccatcggggaggggagttgaagtgacagcctcctgacagcttagaaatgtggaggacgcagcaagttctggacatggccagccatatgaatgatatcttctctttctttgaaccatctccacctgctcttatggacaccccgccttggggcaaggcaagggatgggcacaacttggaagattttggctttgtgatcctcagtgtccagtgtcacccagatgggccggaagctgcctttgaagccaacgaatgccatttgctctgaaaagcaatgatgagtctcctgagcaaaagccctatgagaggacggctgccccaccccgttccatggctccccatcgccagccccccacgcccaccaggtaccgcctagccacactgcactgtggccccttgggaagagctctgtgctcagctactgatggtgcctgacatgtgtttgtatggggcaggcagggtctcacctgagcctcactgccacctaggcagggtgatggctttgttgtagacaggggagccatgcacagcaggaaatggggcaaactgtaagggaggagacctcctaggaacctgcctaccttcgagctgcccctaggacaaccagcaagtccctgcccctctctgaagcccagtgttcccatccatcaaatgatggcattgatctacaagatctccttccccactctatcactctgtggctctagaaagagttctgagaggtgaagaaatctgaccaagagtgtggagtaaatggtgcaccccagattagaactctaaacccctgaaacccacacagcactctccatcttgcagttcacagcttgagcatccgaggggcatgggaatccacgtctatactcagcccatcttggcaggcaacatgcatttatcaccaccgggaaagtgccattcaacttaggtcaccttacatacatcagcttttggcaaccgggatcttaatttaaaagacagaggctccaaaatgatttcaggactgggctggaaaggatacttctcttttccttatgtcctcctttggctggtttgaagggtttgcattgcttctgatttttctcattgccccatatgatgggtttctgattttgatgttttccatagtgaggatggtgtataactaagaagcccagctttgagttaggaagattaggatccaagtcctaaccttaagcaagtggcttggctgttaaattcttggtgtcctcatcttaaatggaaataatagtacctgctgcacaggttattaatgagtaagtgagataattataacatgttgtgcaaagtgcaaggctgaacattgaatagcaaccacaatgatcattatcattattgcccgtggagcttctctgccgcccatacagcctctctgaggactctccctgcacctagtttttgtgatgataatgggtgtcatgctgacatgtccctcctggatggcttcttccagcacagccagcaagcctgtgctaggcttcaccaccgaagctgcctggccttggacaagccatgtaggttctctgggctttagttttctggaacaaataagagttttgcaagctgcaaaggactgtacaaacgctaggcatcagctagaatgttgaagaagatgcaggacccctggccagtctgaatagcaggaattgggtaggagggtgagactaagccacttttcttatgatacttttgttgaataaagggccactttccaagca

SEQ ID NO: 354376 - DNA, 2020 bp, Homo sapiens
ccggacctcaggcccagttcagtgtacttcccctctctacttcctccctccagtcccttctccatccctcccttttttggctgccccttgcctgccttcctcgccagtagcttgcagagtagacacgatgacaccttttgcaggctaaaaaggctgagagtggcactatgtgcagtgagccaccatggaggaccaagcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354377 - DNA, 2020 bp, Homo sapiens
gccctgcctaacaccaggcccaccgaaccttgaggtaaagggccagtgacccccatggggacaattaaaggcaaagaattaggtagtaaatttagaggaatggtactacagagatcgaccgccctgctgcctactgtggaggtagacaagcattgtactgagacagaagaagaggctgggacccatctggattggctcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354378 - DNA, 3347 bp, Homo sapiens
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggtatgcaggtggggctggctctgtttgaggacagggcatgtggcaggggtgcaggagccctggccatgggctccctccaggtgtacagcaaggctacacctgccacgccacccagaatgggtgctccatcctgtaaccaggccacagcggtgacaggcagaaggggaagttcccaggggcccaaacctccccgggggaccccagaccccggcctggccacagctgctccccacacacaggaggtatcaagaaacggggctcatccttagcagcctatcccaggtggatgttggcgtggaaggtgtcccgggtgggctaaagtcgggcatctcaagttgctgccccacagggggctgcagtcgggaagctggcctcccaccgaggcctcccaccaaggcctggctcctgcagagttcagcgcccgctcatttccctatctcccagaaggtggagacgctgccctgtgatggccggccctgcccagcctgccctgcacatctggttctgttccagctctgcagagccaggctgaccggggggcatgttgttcatcgtgacctcttctggggaggaagaaactggcaagggctcctggcctctgccccagggatgcctgtgccagagccccctcgcctcgtggtctaatagtgcatcctccggcctgggctgcagggcaggggccggggcagggtgggccctcagcccgtgccatccagcccacctggggcacccccatggctgtcagcccctcccagggttggggtgtttgggctccatctctcccccggggctgaggtggagaccaggcagagcagtgggctccccccaagatgcctgtggacaggctctagggtctgcatggcgccgaggggctctggggaggcctctctgggggtactcagggccccctgcttcaccgtggccgcctccccccggcggggccgcgctcgatagggataaacaaagggcatcctgaggaaactcttatcagaacattacacctcccagagctgttttgttaggagcctgctataaatttttatcatttcaaaatatttttgtagcaccgcgtcgctccctgtgacgcatcgccctggggtggggccattctctgctgggtttatttctcacccatctcccttgggggtccctgggtgtggcagtgggagacatagctaggctgatgtgaggggtgggtggctgacctgtgctgaccttcctgttgttggcaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354379 - DNA, 642 bp, Homo sapiens
cttgtgacggagggcagccttcacaactgaaaggcacgtggacttgagaatgttttagtccaccttggtggctcatgcttgtaattctagcaccttgggaggccaaggtggaaggattgcttgaggccaggtgtttgagaccagcctgggcaacatagccagaccccatctctacaaaacaaaaaaatttagctggacgtggtgatcggtgcttgtagtcccagctattctggaggctgaggctagaggatcacttgagcccgggaggtagaggctgcagtgagctgtgattgtgccactgtgcccctgtcgtgggggcccttccgggtctatgtcccagccctgtgctgaccgtgttccttctcacctttcatccctcccccaagcagggcagtggactacaatcttctgggtgacagagtgagatcctgtctcaaaaataaatagaataaaaaagaaaatatcttagttctgtgtctggctgagaacactgggtgaggtttgagttcagagtggttggtatggtgtgcgtgtgatttgcaaagatgatcacacacgcccacggccaacctcaccaccatatggcttggtctctggatttgcacagactatgtgtatcgagtcactctttctgctctgttg

SEQ ID NO: 354380 - DNA, 940 bp, Homo sapiens
atttgttatggactgtgacgtgcagatcaagctgcacgtcaggagcacatggaacgctttggggtccctttttagccggggattccagtgaatgaaaacggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354381 - DNA, 1075 bp, Homo sapiens
atttgttatggactgtgacgtgcagatcaagctgcacgtcaggagcacatggaacgctttggggtccctttttagccggggattccagtgaatgaaaacggtagcaggggctcttttgagcttggtcatggggcagccctccgagggcagagtggagggcagcaaacaggagaatgagcaacctacctaggtccttgggatgcccctcaggaggacgagctctagggggaatgctgggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354382 - DNA, 988 bp, Homo sapiens
actgcacccggtctctaagtggacattctgagaaacagtttaaacacaaccgctctaggtcaaagccactgaagataacctttcagccccctctctgtttccttcaggtcgagtcccagacaccagaagtctgaatttggagaaggctggggtagatactagccccgacactcagaagatcctggtggactcccgggaagccacctctgtgccccacatctacgccattggtgacgtggtggaggttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354383 - DNA, 2046 bp, Homo sapiens
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354384 - DNA, 1006 bp, Homo sapiens
atttgttatggactgtgacgtgcagatcaagctgcacgtcaggagcacatggaacgctttggggtccctttttagccggggattccagtgaatgaaaacggtagcaggggctcttttgagcttggtcatggggcagccctccgagggcagagtggagggcagcaaacaggagaatgagcaacctacctaggtccttgggatgcccctcaggaggacgagctctagggggaatgctgggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354385 - DNA, 382 bp, Homo sapiens
cagatcaagctgcacgtcaggagcacatggaacgctttggggtccctttttagccggggattccagtgaatgaaaacggtagcaggggctcttttgagcttggtcatggggcagccctccgaggtcagcaatgtgcagaaggggtttggagagaaggcttgagcatgtgagggtggcacggccagcctcatcagcagcggactcctttcccagggcagagtggagggcagcaaacaggagaatgagcaacctacctaggtccttgggatgcccctcaggaggacgagctctagggggaatgctgtacgtcaccatgctcggtgccagtgttggggattttctaaagggagatgcccactcggagggcaaagggtgatggcat

SEQ ID NO: 354386 - DNA, 294 bp, Homo sapiens
cactctttctgctctgttgtgtggtgtcttgtcacccctgaccatcacagaatggagtgtccaatcctgataaaattgatcctgtaccacgtttaaccagacagacagtccgtcccacctctcatcccttctctcagcacaggtcagcgggactatgatctcctggtggtcggcgggggatctggtggcctggcttgtgccaaggagggtatgtattctgtatacttcgtggcaaggcctcgaagcttttagggcccctagagagggtggtgctgtccagaaaacgtccatgag

SEQ ID NO: 354387 - DNA, 2115 bp, Homo sapiens
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354388 - DNA, 2000 bp, Homo sapiens
  misc_feature (157)..(157): n is a, c, g, or t
  misc_feature (183)..(183): n is a, c, g, or t
cagagtgagactttgactcagaaaaaaaaaaaagaaaagaaagcgtgggtcatttgtttctgtgcactatgctcccagccactgttttgccagccttgtcatgcccgttctcttggtgttaccacacccctgaaatcagaaggtgacaccatctggngggcaccacagctccctgctggaacntgtccgggtgatgaggactgtccccaagagaggtccagccacctcttgctgcacaccagggctgtacgtggcctcttaggaccgtgctgagctggcttccgtccctgctttgacacctgtggttaacatgtccctgggatccctgggggacaggcgaggtgcccccacatcccctccatgcttctcagcatggttgccgcttacctcttggtccatctgagccacagcaccaggccctgctgggggctggagctcccttttaccagtgttccctattgatccagttggtgaggtttaatttgcagaggaagtgtttgaaaatcttatctttatctttcagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354389 - DNA, 7270 bp, Homo sapiens
  misc_feature (1000)..(1000): n is a, c, g, or t
  misc_feature (1271)..(1271): n is a, c, g, or t
  misc_feature (2656)..(2656): n is a, c, g, or t
  misc_feature (3626)..(3626): n is a, c, g, or t
  misc_feature (3745)..(3745): n is a, c, g, or t
  misc_feature (4046)..(4046): n is a, c, g, or t
  misc_feature (4931)..(4931): n is a, c, g, or t
  misc_feature (5169)..(5169): n is a, c, g, or t
  misc_feature (5321)..(5321): n is a, c, g, or t
  misc_feature (6418)..(6418): n is a, c, g, or t
  misc_feature (6433)..(6434): n is a, c, g, or t
  misc_feature (6729)..(6729): n is a, c, g, or t
  misc_feature (6741)..(6741): n is a, c, g, or t
  misc_feature (6804)..(6804): n is a, c, g, or t
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctgtatcctttgcaagcgtgcaggtggccgtcctgggaactggacactccttcccttgagtccctccctgccacccgcccttccggcaggctctttgctgcctcagatcggcacttactgggcctctcggngtggaggatctactgtgcctggggacagtttgaggctgacctctggccagggattcctggaggctcttcctgagctgggacagctggacatggccatgaggcagctgggctgtcctccctcaagagcagccccagcctggacccattgcttcagaagggacaattagacagggagggtcaggagaggagctgcaggagggcctggggtcaaggggacatctgagggagatgaaagtccctggccgggcgcggtggctcatgcctgtagtcncacctcctgggtagctggggctacaggcgcccaccactacacctgactaatttttgtatttttagtagagacggggtttcaccatgtaggccaggatggtctcaatctcctgaccttgtgatccacctgccttggcctcccaaagtactgagattacaggtgtgagccaccgcacctggccagtatgtattttttctttagcatattaaatgttttgctgcttcaggctttccagctaggtttttttctttttttgcgtgtgaaacagggtctctctctgttgcctaggaggagtgtggtggtgtgatcatagctcactgcagcctccacctcccaggctcaatcaatcttcccatctcagccttctaagtgctgggattacaggtttgagctactgtgcccagccaagctagtttgttgtttttaacataaaaatgatatggatttgaaagttttaaaaattatggtgacatacacataacatcaaattcatcatcttaagcattttaaagtatatagttcagtggtgttaagtacgttcatattgtacaagcagcatgaccatccatctctagaacttttccattatctccaaactgagctctgtccccattaaacactcactccctgctgcccgggcactcacccttcactgtgtgtctctatggatctgactcctcgagggacttcatgtaagtagaatcatgcagtgtttgtccttttgtgactggctcatttctcttagcacaatgttttcagggtgcatccatgttgcagcatttgttagagttagcatttgtgtagcatgtgccagcatttccttcctgttgaaggctgagttgtatgtgtgtccatcatctgtcagtggacacttaggttgcttccgtcttttggctgttgtggatcatgctgctgtgaacatgggtgtgcacaagccgcctgttttcagcacataaaaatgacacagagtttttaaagttctgtccagccttctcgtggctttcagtgtttcccagtgggtccctttgggcctggcaggtcatcacatgccaggagtggcattttgcaggcctttccagaagtcacatttcgaaggcttccaaagacatcacccttccagtgctgggcagaggcctgggcgtttcccggccaggcgtgggctggctacaacttgctgggcacagtctggtctcaccttcttgctctctgtcaggtgtaggtccggttttgcatggggcagtggccgagcaggtgtggggagtgtggacacagccaggggatacctgtgcccaggcctgggccggggctgtctgacgggactggcaaggggcagctggagccaacagggatcgcccagacactgctctgtcccaggcctgctgcanaggaggccattgcagatgggccgccgcaaggagggctgcgggtcctcgtcagggtgggtggcggcacacacagcatgcctgctcagatgtcctacccacctcggtgcctggccgtctagtttaggctcctagttttcccaatcaccctgtcaacttgcatgttgaaggcgggagcaacctagtcagtgttgttagttctccgaggcctttctgtgctgagcctggtccgttgtcccctgcgagagcccaagatcagagccagggtccctctcagatcacctgcctccacctccatcagctaaccgggcttgcgtggggctggccaggggtcagtgtctcctgggggagggctcccagaggcacaagctgtgtcatagggtgatgcacttctgaagcagtcactcggaatgggaaatcagaaaggaaaccagcctggagcggctgaggcttcacttttgtgcagtggacacaagcgcagaggtgatgaccggggaggacctgagatgcctgagcgcacgcagggctcttggcccggaggtgatcagtcagcaagagcaatgttctcagccacgttgtaaaagtagattttaagtaagtttattatgataaacactacgaaggattaggtaacattttggactctggagtgtactgatggttctcatcctaaactccactttatttttctttcaaaatttatcctcctactgtcattcccaaataaactccactctaaaggggaggtggcgagtttctccctcccaccgcgccctagccctcctcctctgtctgctgacacctccgttcacccacagcataagggagctgttgccattgaaccgaggggcagccctcgaccaagcccatagggatgtagcagaccaatgggccgggggctgtgtccccggaaagccggggcgtcagcctggcaggcaacaagcgaggcccctccctactcagcagagctgcngtggcctgcacgcccatcctcccttgctaggagtctgttttatttttttgtactttcaaaatgagcatcccccagacagtctgcctggcatgattgatgctgggggtggaagcttttcncagtccttggcctctgaccctgcttcccgagggcggcgcggcttctgcgcgcctgctgggggccgctcgggcatgtgctgacttcgctgctgctcagagccaggttttgtaaacattcaggagccacttcccaggtcagcaactgcgagcgttttctgctggtttgtacgataagcctttaaccaagctttatttctacttgcaataaaggatgatccactctgggaggttaaaataaagcgccctaggggcggcacagctggcaatgccaacatctccgactctgcttcctgtaccgggngtgcactacgtccgcacaagctgggctccgacaggaaggggggatgcctccgtgcccggtgcacacacacacagaaggggcccaggtgctgcacagagctcccgtgtggggccgagtgctggccctgcccgttgcccgtgtgcctggcgcctggccgcagctggcgaggaccatggacattggcattgcgaagtgggccctgcagtctggaagcagaggaggaccagagccccttcctcgacgcagccttgatctccacgtggtggattaaacatattagcagttaaagcagttaattgctgtgcagggggcccccgctcattgtttgtctctgaatcacccgcccacaccaggtgtctcagataatagactgggaacttcagtgaggaggatttcctgtctgcagatgtgccgattacagcgctgagtgaagacagtcagccagcactgctgcgggctcgaattcgcccgctgagttaaccagttgtggcctgaatccctggctgtctaggggagcagggccaggctggggcatcctgagcaaacgcctcccagtgcaggggcttctaagtgcagttaagtttagatttggttttaaagaagggacagactgcctctggactgcagccctgaaaaactggaagttgagatcttcatgtgcccctttggcgtccccagcccctctggatggttctctgtccctctcttgagggtgagatgctgaaggctctggcgtatccctccctgcaccacaggagtcctgcccatggccagaagagccagcagacacaggaggggactcgctaaacctgggggtcccacagccaggcagctgttgtgcctgagtgccagggagggtggccacaggtctgcctggggccttgngatatggcaggtgagacgagacccagggaaggaatccgtctggatcttaccccagccactgaagctatttcctctttgggctttatcttagataactcagagatgtccacctgtgtgtaaaccagcatcagagcctgaaacacaacatgcatggagcatgggagcttggcttcccggcttcctcttggcaccacacagaggccacccccacagcctgcccctgtatagtctcccccangtggcacgtgtgcctggaccacagccagagagactggggtgcccaggagatgatgatgggggctggcggtgcccaggaggggagctgttgccagggtgggctgcagccctgggctcctctctccacccaggcactgtttgctggcatgtacncggcaggcaactgtctttgctcagctgtgctcggctgatggctcccgtacaccgcagactcagctacacaagtccctgcggattgtccctctgttgagtgccaggcagcaggaaagggcagaaagcaagaaccaagctggggatgggtgggagcatcctaagcctggtgagagggaaggggcggctcctcctggatgccctctgtgctggtgtgggtgcagctggggcttaggggccgcggtgggtgtggatgctgcccgggcgagggggctgcggtgggcccatcaggactgctctcagggatgcgccttgctgcagctgcgtgaaaccaagtttgtggctatgctcttcccggtggggatgggcccagcagtgaccctggcatccacatgcctccatgctctcagggtggagtggccatccctgagcaggtgacacggatcggaggcccctctttgatagtctaacacctttttattttagtgcaaatttagtttgtaattaatgacatcaagagagacccaaatctgcctccattgtgagtttgatattttttgaagtggggccaagatgaacattcatggagctcttcctatgagcggtggctgcggccttcccctccacaccacgtggccccgggcgtgcgctgctgctcctgagacagcactgttggctcagccctagctcatggtggtgctaacacctcacagaggccaggccagagtagcaggaggcagcgccctgtgcttacccaccagcctggtgccccacgcttggcttgagggctagttcacacttatgtccagagcccacagctatctgacaggccagccggcacctgcatacatggttgtccaactgggtcttgttaccatgacaaattcagtacttaatgattagaactgagtggaaaccaattaaaaaaaaaagaacaacatggtgaaaagtcttctagagataggtcagcaccatttatgcatattaccatgcaccctctaatgtctgcaggtgccctggggcagccaacctgttacaattgcaattatgttaacaattgttaaagggccgggtgaggtggctcatgcctgtaatcccancactttggaatgccnnggtgggaggatcatttgagcccaggagttcaagaccagcctgagcaacagagtgaaacctcttttcaaataattaataataataataataataataattgttttttgtttgtttttgagacggtgtctagctctgttgcccaggttggagtgcaggagcgcgatctggctcaccgcaacctccacctcccgaattcaagcgattctcctgcctcagccttccaagtagctgggattacaggcacccgccaccgcgcccagctaatttttgtatttttagtagagacagggtttcnctgtgttagccnggctggtctcgaactcctgacgtcatgatccgcccgcctcagcctcccaaagtgttgggattncaggcgtgagccactgcacccggtctaataataactgttaaagcaataatgaccactcgccacagagcacgctccttcctgggggtcctctgggcctgagctgggggctgcgccgtactccaaggctgactgtggggtcttacacatcataatgcacataggcagcttgagtaggaaaggcccttatgctgcctgaggggaagctcacccccaccccccaaggagccgccctgggtatgagacatccctggaacggcctaggggtccctggtggctgctggcagtcacagcaagtggccaatcaggtcccattgaggcccaggggctcactcatttattcaactaacatggcgtctcgatgggacctgaggccagcagggcaggtgcgtccccttccccctggtgggctcatagctgcgggtaggggcccggggctcattgagaaggtgcgattccagaaaaaaaa

SEQ ID NO: 354390 - DNA, 1433 bp, Homo sapiens
cacagccatttgggagaaaatttaatttaagtggcacattccgctggtgtgatgggatgtccttgtgttcagcaatagggagaccagctgtcctcctggggcttgttaccagactgcaaagcccccgccacctctctgtgtgcgtccctgtggctaagacatgacaaggtagggctttcagtggcatttatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccaggatggctgcaggccaggtttggggggcctcaaccctctcctggagcgcctgtgagatggtcagcgtggagcgcaagtgctggacaggtggcccgtgtgccccacagggatggctcaggggactgtccacctcacccctgcacctctcagcctctgccgccgggcacccccccccaggctcctggtgccagatgatgacgacctgggtggaaacctaccctgtgggcacccatgtccgagccccctggcatttctgcaatgcaaataaagagggtactttttctgaa

SEQ ID NO: 354391 - DNA, 1909 bp, Homo sapiens
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtcgagtcccagacaccagaagtctgaatttggagaaggctggggtagatactagccccgacactcagaagatcctggtggactcccgggaagccacctctgtgccccacatctacgccattggtgacgtggtggaggggcggcctgagctgacacccacagcgatcatggccgggaggctcctggtgcagcggctcttcggcgggtcctcagatctgatggactacgacaatgttcccacgaccgtcttcaccccgctggagtatggctgtgtggggctgtccgaggaggaggcagtggctcgccacgggcaggagcatgttgaggtctatcacgcccattataaaccactggagttcacggtggctggacgagatgcatcccagtgttatgtaaagatggtgtgcctgagggagcccccacagctggtgctgggcctgcatttccttggccccaacgcaggcgaagttactcaaggatttgctctggggatcaagtgtggggcttcctatgcgcaggtgatgcggaccgtgggtatccatcccacatgctctgaggaggtagtcaagctgcgcatctccaagcgctcaggcctggaccccacggtgacaggctgctgagggtaagcgccatccctgcaggccagggcacacggtgcgcccgccgccagctcctcggaggccagacccagatggtgcggccaggttggggggctcaacctctcgggggccggaaagggaggggacgcaaggggagggggcggtcccaggg

SEQ ID NO: 354392 - DNA, 4009 bp, Homo sapiens
  misc_feature (1670)..(1670): n is a, c, g, or t
  misc_feature (1908)..(1908): n is a, c, g, or t
  misc_feature (2060)..(2060): n is a, c, g, or t
  misc_feature (3157)..(3157): n is a, c, g, or t
  misc_feature (3172)..(3173): n is a, c, g, or t
  misc_feature (3468)..(3468): n is a, c, g, or t
  misc_feature (3480)..(3480): n is a, c, g, or t
  misc_feature (3543)..(3543): n is a, c, g, or t
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccataggtgtctcagataatagactgggaacttcagtgaggaggatttcctgtctgcagatgtgccgattacagcgctgagtgaagacagtcagccagcactgctgcgggctcgaattcgcccgctgagttaaccagttgtggcctgaatccctggctgtctaggggagcagggccaggctggggcatcctgagcaaacgcctcccagtgcaggggcttctaagtgcagttaagtttagatttggttttaaagaagggacagactgcctctggactgcagccctgaaaaactggaagttgagatcttcatgtgcccctttggcgtccccagcccctctggatggttctctgtccctctcttgagggtgagatgctgaaggctctggcgtatccctccctgcaccacaggagtcctgcccatggccagaagagccagcagacacaggaggggactcgctaaacctgggggtcccacagccaggcagctgttgtgcctgagtgccagggagggtggccacaggtctgcctggggccttgngatatggcaggtgagacgagacccagggaaggaatccgtctggatcttaccccagccactgaagctatttcctctttgggctttatcttagataactcagagatgtccacctgtgtgtaaaccagcatcagagcctgaaacacaacatgcatggagcatgggagcttggcttcccggcttcctcttggcaccacacagaggccacccccacagcctgcccctgtatagtctcccccangtggcacgtgtgcctggaccacagccagagagactggggtgcccaggagatgatgatgggggctggcggtgcccaggaggggagctgttgccagggtgggctgcagccctgggctcctctctccacccaggcactgtttgctggcatgtacncggcaggcaactgtctttgctcagctgtgctcggctgatggctcccgtacaccgcagactcagctacacaagtccctgcggattgtccctctgttgagtgccaggcagcaggaaagggcagaaagcaagaaccaagctggggatgggtgggagcatcctaagcctggtgagagggaaggggcggctcctcctggatgccctctgtgctggtgtgggtgcagctggggcttaggggccgcggtgggtgtggatgctgcccgggcgagggggctgcggtgggcccatcaggactgctctcagggatgcgccttgctgcagctgcgtgaaaccaagtttgtggctatgctcttcccggtggggatgggcccagcagtgaccctggcatccacatgcctccatgctctcagggtggagtggccatccctgagcaggtgacacggatcggaggcccctctttgatagtctaacacctttttattttagtgcaaatttagtttgtaattaatgacatcaagagagacccaaatctgcctccattgtgagtttgatattttttgaagtggggccaagatgaacattcatggagctcttcctatgagcggtggctgcggccttcccctccacaccacgtggccccgggcgtgcgctgctgctcctgagacagcactgttggctcagccctagctcatggtggtgctaacacctcacagaggccaggccagagtagcaggaggcagcgccctgtgcttacccaccagcctggtgccccacgcttggcttgagggctagttcacacttatgtccagagcccacagctatctgacaggccagccggcacctgcatacatggttgtccaactgggtcttgttaccatgacaaattcagtacttaatgattagaactgagtggaaaccaattaaaaaaaaaagaacaacatggtgaaaagtcttctagagataggtcagcaccatttatgcatattaccatgcaccctctaatgtctgcaggtgccctggggcagccaacctgttacaattgcaattatgttaacaattgttaaagggccgggtgaggtggctcatgcctgtaatcccancactttggaatgccnnggtgggaggatcatttgagcccaggagttcaagaccagcctgagcaacagagtgaaacctcttttcaaataattaataataataataataataataattgttttttgtttgtttttgagacggtgtctagctctgttgcccaggttggagtgcaggagcgcgatctggctcaccgcaacctccacctcccgaattcaagcgattctcctgcctcagccttccaagtagctgggattacaggcacccgccaccgcgcccagctaatttttgtatttttagtagagacagggtttcnctgtgttagccnggctggtctcgaactcctgacgtcatgatccgcccgcctcagcctcccaaagtgttgggattncaggcgtgagccactgcacccggtctaataataactgttaaagcaataatgaccactcgccacagagcacgctccttcctgggggtcctctgggcctgagctgggggctgcgccgtactccaaggctgactgtggggtcttacacatcataatgcacataggcagcttgagtaggaaaggcccttatgctgcctgaggggaagctcacccccaccccccaaggagccgccctgggtatgagacatccctggaacggcctaggggtccctggtggctgctggcagtcacagcaagtggccaatcaggtcccattgaggcccaggggctcactcatttattcaactaacatggcgtctcgatgggacctgaggccagcagggcaggtgcgtccccttccccctggtgggctcatagctgcgggtaggggcccggggctcattgagaaggtgcgattccagaaaaaaaa

SEQ ID NO: 354393 - DNA, 1443 bp, Homo sapiens
attccccacaccctatcccagtgttccaccctaggtctgaaggcccccgccccgaatccggccgcattcggccccggtctagccagcgctctcacctctcccgcgacggcccgcccgggactggacccgccccggtccggcgcaggcagcgcggcgggcagccctagctgccccagaagccccacgacgatggcggcaatggcggtggcgctgcggggattaggagggcgcttccggtggcggacgcaggccgtggcgggcggggtgcggggcgcggcgcggggcgcagcagcaggtcagcgggactatgatctcctggtggtcggcgggggatctggtggcctggcttgtgccaaggaggccgctcagctgggaaggaaggtgtccgtggtggactacgtggaaccttctccccaaggcacccggtggggcctcggcggcacctgcgtcaacgtgggctgcatccccaagaagctgatgcaccaggcggcactgctgggaggcctgatccaagatgcccccaactatggctgggaggtggcccagcccgtgccgcatgactggaggaagatggcagaagctgttcaaaatcacgtgaaatccttgaactggggccaccgtgtccagcttcaggacagaaaagtcaagtactttaacatcaaagccagctttgttgacgagcacacggtttgcggcgttgccaaaggtgggaaagagattctgctgtcagccgatcacatcatcattgctactggagggcggccgagataccccacgcacatcgaaggtgccttggaatatggaatcacaagtgatgacatcttctggctgaaggaatcccctggaaaaacgttggtggtcggggccagctatgtggccctggagtgtgctggcttcctcaccgggattgggctggacaccaccatcatgatgcgcagcatccccctccgcggcttcgaccagcaaatgtcctccatggtcatagagcacatggcatctcatggcacccggttcctgaggggctgtgccccctcgcgggtcaggaggctccctgatggccagctgcaggtcacctgggaggacagcaccaccggcaaggaggacacgggcacctttgacaccgtcctgtgggccatagggctcccccatcctgctggctgccaggcgggttggccgctccccagtgcacctcgagagcaaccgtgaaggcctgtggggcggcactcacactaggctgtgcccatcttgccatccccagcaccttgcatctctgcgtgtctccccaccaccgtgggacatgctggaaaaaaccagagaagagactgagacggcatcagccaggtgtcctcatcgaggatcaactaggcaatcatcctcgccttccctggcccttgagcaattgcttattaaggtttcagcacataaatcctacttgtcaccttc

SEQ ID NO: 354394 - DNA, 4134 bp, Homo sapiens
cgcgggcgggaccgcggcggtcgggggacaccagctgcgtcggagcgcccagaacgccccgcgctccgccgagccccgctccacgcagacccgcgggcgggagggagccacgcacatcgccgccgcggccgtctccgcggggcggtaaccgagcctgcctcggagccgccgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagctcgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagctcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaattggaactccataaggaggggccaaattgggagaccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagag

SEQ ID NO: 354395 - DNA, 4423 bp, Homo sapiens
cgcgggcgggaccgcggcggtcgggggacaccagctgcgtcggagcgcccagaacgccccgcgctccgccgagccccgctccacgcagacccgcgggcgggagggagccacgcacatcgccgccgcggccgtctccgcggggcggtaaccgagcctgcctcggagccgccgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagctcgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagctcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaattggaactccataaggaggggccaaattgggagaccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcacgggttttgatgggatagcagacaggtggattgcagagctccggaaagacccagccgggtgtcaagaagagccctcctagtttggcctctaactggctgtgtgaccccaggcaggtcacttgtcctctctgggaagcagctgaataatgaacactgggattttcccaggct

SEQ ID NO: 354396 - DNA, 4616 bp, Homo sapiens
cgcgggcgggaccgcggcggtcgggggacaccagctgcgtcggagcgcccagaacgccccgcgctccgccgagccccgctccacgcagacccgcgggcgggagggagccacgcacatcgccgccgcggccgtctccgcggggcggtaaccgagcctgcctcggagccgccgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagctcgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagctcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggtgagtgcccgcagctgcgcctgggcgtatgcctttcctggaggcggggacgatccgggtaggagacaaagggcgagctccccttcctccaggctcatgatggtgttgctaaggaatcacagacacctaaggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaattggaactccataaggaggggccaaattgggagaccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctgaaa

SEQ ID NO: 354397 - DNA, 3652 bp, Homo sapiens
cgcagggaggctgcccttggtctgattgaccaagtgggagagggtgggctgaggccaccccctgccacccagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaattggaactccataaggaggggccaaattgggagaccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctgaaa

SEQ ID NO: 354398 - DNA, 4057 bp, Homo sapiens
accacccagagaaaagcatttttaatatttggatgtatgatcttttggcctttttaaaggctgtatttttgggttttttgtttgtttggcttataggcgattgttttttctttttgctgaactgaattttctacaaaataccgttttatattttgtataacttgtatgatttaaaaaagaacgatgagtttgattccctgttaagccactttcaaaagggtatcttggatagatctacttctcagcctgtgtcctgacatggcaatggtagcctcaaaaggtgattgttaaggttagatgagacaatgtacgcaaagagggtgtctgtgtgtttgctggggggtggttgctccctggctttccaggatgttaggccttcgtcagtgcactcgacagacggttactgtttgtcaacagaatgcttggcgctgttctagctgctagggataagacggaaggagcccaggagttaaatttttgaaaattttaaattatgaggaatacaagtttactgtagaaaatgaggaagtacacatatgcatatagcaagcacctgtgagcatttggaagcatccacatggtttcagtttcggtgcttccccccacctattcctctgcttaaacagatgtcctgcaagagtcgtttcttgactgtgttcgctaatttatgtcacaagcatcgtgtgcgccattagccatccgggattgtaacggtgcgcgcgtagggaccggacagcggggcgcgccggggccgcctcccgagagccctgcgtgacactgccccgtgtctcccgcgcagatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaattggaactccataaggaggggccaaattgggagaccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctgaaa

SEQ ID NO: 354399 - DNA, 1533 bp, Homo sapiens
cgcgggcgggaccgcggcggtcgggggacaccagctgcgtcggagcgcccagaacgccccgcgctccgccgagccccgctccacgcagacccgcgggcgggagggagccacgcacatcgccgccgcggccgtctccgcggggcggtaaccgagcctgcctcggagccgccgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagctcgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagctcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttggtctggatacccgacaagagcggggacagtggccctcctgtgccttccagagtcgagcttacaagagctcaaggcatcaaggatcaactgcacatgttgggcacagataggccaccagggccccagcagtgctggtacaaggaagaggggcagtgcagcgcccaggatgccagattcagtggggaaggtcggtctgcctgccttatagttccccggaggctcccgagggctttgtctggttcagttattcctgtgcactctagttttctaccacaatgaatatatatcaagttgaaccatatgtaa

SEQ ID NO: 354400 - DNA, 4485 bp, Homo sapiens
cgcgggcgggaccgcggcggtcgggggacaccagctgcgtcggagcgcccagaacgccccgcgctccgccgagccccgctccacgcagacccgcgggcgggagggagccacgcacatcgccgccgcggccgtctccgcggggcggtaaccgagcctgcctcggagccgccgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagctcgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagctcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaattggaactccataaggaggggccaaattgggagaccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctgaaa

SEQ ID NO: 354401 - DNA, 3918 bp, Homo sapiens
gattcggcacgatgaccagccggccggcccagcagaggtggctgcactgcccgtcgccggagatggggggacagatcacccggagcactctccacgactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaattggaactccataaggaggggccaaattgggagaccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctgaaa

SEQ ID NO: 354402 - DNA, 4050 bp, Homo sapiens
aaaaaacccaaaaatacagcctttaaaaaggccaaaagatcatacatccaaatattaaaaatgcttttctctgggtggtgggcttataggcgattgttttttctttttgctgaactgaattttctacaaaataccgttttatattttgtataacttgtatgatttaaaaaagaacgatgagtttgattccctgttaagccactttcaaaagggtatcttggatagatctacttctcagcctgtgtcctgacatggcaatggtagcctcaaaaggtgattgttaaggttagatgagacaatgtacgcaaagagggtgtctgtgtgtttgctggggggtggttgctccctggctttccaggatgttaggccttcgtcagtgcactcgacagacggttactgtttgtcaacagaatgcttggcgctgttctagctgctagggataagacggaaggagcccaggagttaaatttttgaaaattttaaattatgaggaatacaagtttactgtagaaaatgaggaagtacacatatgcatatagcaagcacctgtgagcatttggaagcatccacatggtttcagtttcggtgcttccccccacctattcctctgcttaaacagatgtcctgcaagagtcgtttcttgactgtgttcgctaatttatgtcacaagcatcgtgtgcgccattagccatccgggattgtaacggtgcgcgcgtagggaccggacagcggggcgcgccggggccgcctcccgagagccctgcgtgacactgccccgtgtctcccgcgcagatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggctccactatcctggccgagcggggtatcccatcactcccctgctcccctgcctccacgccaacctcgcccagtgccctgggcagccgcctgtctgaccccttgctcagcacgtgcagctctggccctctgggtagctctgctggtgggacagcccccaattcgccagtgagcctgcccgagtcgccagtgaccccaggtctgggccagtggagcgatgagtgcaccatttgctatgaacacgcggtggacacggtcatctacacatgtggccacatgtgcctctgctacgcctgtggcctgcgcctcaagaaggctctgcacgcctgctgccccatctgccgccgccccatcaaggacatcatcaagacctaccgcagctcctagcccgttgcggtggcccatcccgcatacccatcttctcgggcttcagcccagtcccagctgaggaacaagccagtggggccccttctcttcctcattttggaaacttttcctcctctattaaacatgggaaactgaagcccttgaaggtttggggagaggggggtatcaggcagggagggggcagaggcaaatcaccgggcagagggaggggaggagaggaggccgcactctccctgtctctcccgtctctgcacccagctcctctctgcatgctgagggctaaattgggatctcagcctgccctaatctttccccatctgaggcaggtttctaggaggtgtctgtagtccatgtggcacctttgtgagaattagaaaacatgtaccttcctctgggcagctgcagccctgagccaggacatgtggcctggctagtgcagcatggagtggattttaggctcatttgccctctcagccaactgcccttgagcagtgtacagcctgctcaacaaccgccctgggcaggccgctcctgagctgctgtctccctctctgacctatgcctaccttctctttcttcgttccctgcccactgggcatggcagctgggggtgagaggctggtggttgcctcccgtcctgggcaggctgcagcctcatgccatgtctctctcccactacctgatgggcacatggacaggctgcagagggctccaggttctgggcccctggctgagaaggggaggatcctgtcctggctgtagccttcctgccccaatcatctcgctggatgccattgcccaggggtagcccttcggtatgggctggggagaagggttggtcttctgccagggtccctaagaacaggtttgcagctaccctctctgaccttttccccatatcttgtgctgtccagggcctaggctgatagtcagagcctgtggcacacctgggatgggccagggccctgggtggggaggtgtgggttccctgggccaagaccagcctttttcctcagtttaattaatttatttatttggtttgtggttttgggttttttttgtttgtttgtttgtaggtgagttcccatcctctgggcccctagaaatgctgcctttgtgtgtggggtacctgggaaagggtgtggctgaggcagtcataatgcagtatcttcccctgactccagccacaaagctcatacccagccctaccaatcatgaattggaactccataaggaggggccaaattgggagaccttttggcaaacagtgtctattttacagagaggcaaaccaagcctccttagtgccctggggctgatggtcacccagagccatagagcacccttcctcctgggccagagctgggttatcatggttggcttaggtacctcaggtggcccaggaggtcccccctccataaggacgtcaaacttccaggagggccagtgttcctagtgtgggccaggaacaggacagggagaccttgtgatggcggggcagggagcctgttcgtagggaagatgaggaggcaagggctgcctctcacacctccaggttctctaagttctggggagggagcgccccacctgctgaggtcggtcctctcagccctgcctgccctggcctgggctctcccagcctcccagccctctgccccctcagatggctttttgtttttgtttttttttgcatccatcagagactgcacctctgtgtggcaggcagggcatgggttttagtcctggccactgaccagctgtgtggccctggccgagtcgtagccccctggagcccagcttccatttctataaaatggttgtttcgggagagaggggcaggctttctgtgtgactcgggagttcttccgtgagggctgccagggggtggtgtgccaggacctcaggctgggcctttgtgctggccttgcagtgggtgtgtggggaagtcactgtcccactatgggtctccactacccagtcactgaccctgggagaccccttctgtgtgggagggagcgggggctggctagcgggccccccagccagggatcccagaggctgagggttggggagaggaagccatcatctcattacctctgtcagtgcaggggtggctgctgcttcccttgtgcacttgggtcgctgtgattgtgaataaaagtgatttcgtaccagcctgaaa

SEQ ID NO: 354403 - DNA, 2297 bp, Homo sapiens
cgcgggcgggaccgcggcggtcgggggacaccagctgcgtcggagcgcccagaacgccccgcgctccgccgagccccgctccacgcagacccgcgggcgggagggagccacgcacatcgccgccgcggccgtctccgcggggcggtaaccgagcctgcctcggagccgccgaacgcccacgccagcgaccctgactctatggccccgggggagcgcgccggagccgccgcgccgcccacccccagccggaaccctagcgtcccggggagcaagcggggagccccgggcgtccccggccccggcccagggccctgcttgtggcccccgctcccgccacggggcatgggaggcaggtagcccagctcgcgccaggacacccgtggcgggcggaacccgccaaggaccgcgaagtccagagaaaggaagctgaggagctgcccgcccgcccccggctgcagccccagcagggccctcccccggtggcgcgcacccgcgcgcgcacactcgcacaccgcacctcagctcctgcccggcctcgcccccacccgcgagcgccgaacctcctggggccggatgccatgggtaacaacttctccagtatcccctcgctgccccgaggaaacccgagccgcgcgccgcggggccacccccagaacctcaaagactctatcgggggccccttccccgtcacttctcaccgatgccaccacaagcagaagcactgtccggcagtgctgcccagcggggggctcccagccacgccgctgctcttccacccgcacaccaagggctcccagatcctcatggacctcagccacaaggctgtcaagaggcaggccagcttctgcaacgccatcaccttcagcaaccgcccggtcctcatctacgagcaagtcaggctgaagatcaccaagaagcagtgctgctggagcggggccctgcggctgggcttcaccagcaaggacccgtcccgcatccaccctgactcgctgcccaagtacgcctgccccgacctggtgtcccagagtggcttctgggccaaggcgctgcctgaggagtttgccaatgagggcaacatcatcgcattctgggtggacaagaagggccgtgtcttccaccgcatcaacgactcggctgttatgctgttcttcagcggggtccgcacggccgacccgctctgggccctggtggacgtctacggcctcacgcggggcgtccagctgcttgatagcgagctggtgctcccggactgtctgcggccgcgctccttcaccgccctgcggcggccgtcgctgcggcgcgaggcggacgacgcgcgcctctcggtgagcctatgcgacctcaacgtgccgggcgcggacggcgacgaggccgcgccggccgccggctgccccatcccgcagaactcactcaactcgcagcacagccgcgcgctgccggcgcagctcgacggcgacctgcgtttccacgccctgcgcgccggcgcgcacgtccgcatcctcgacgagcagacggtggcgcgcgtggagcacgggcgcgacgagcgcgcgctcgtcttcaccagccggcccgtgcgcgtggccgagaccatcttcgtcaaggtcacgcgctcgggtggcgcgcggcccggcgcgctgtcgttcggcgtcaccacgtgcgaccccggcacgctgcggccggccgacctgcctttcagccctgaggccctggtggaccgcaaggaattctgggccgtgtgccgcgtgcccgggcccctgcacagcggcgacatcctgggcctggtggtcaacgccgacggcgagctgcacctcagccacaatggcgcggccgccggcatgcagctgtgcgtggacgcctcgcagccgctttggatgctcttcggcctgcacgggaccatcacgcagatccgcatcctcggtgagtgcccgcagctgcgcctgggcgtatgcctttcctggaggcggggacgatccgggtaggagacaaagggcgagctccccttcctccaggctcatgatggtgttgctaaggaatcacagacacctaaggtgagttctgggcgggacttggtcatcttgtcagtggcccttatatgtcacctgggagactcacctggggggtgaggcgagggaaagcgcggattattgagtttgatgcccagaatcagatcaacccatagtctcacagatacataaacagtccagaagcacacaacccactgaccactcaaaaatgagaggaaaaggccaggtgcggtggctcacgcctgtaatctcagcattttgggaggccgaggc

SEQ ID NO: 354404 - DNA, 1322 bp, Homo sapiens
tgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccggcgctcccgggccagggcgagcgcggcgaggggcgcaccgaccggttcgcagcggggcgggagtccgagcgcgcgaggagcggcggtcccgggtccttgcgggtcccccgggagcagggcgcgggcactctcggggttcacacgccggtccccgcgcggaccgcggacgcgcgcgtcccccccgcgggcggcgccccttacagggccgagtcggagtcgctggagtccaggctgttcctcagtttgcagctgctgagctgctcccgctgcagcgacaggctctgcgtgctgcggcgcaggcactccaggctctgcaggaacgacttcttggccttctcctcctccatgggggacaccccctcctcctccacctcctggatctcgtcgaaggtcaccggctgcgtcttgaagcgagactggcgcggccgcagccggcccggcccttgggcagcttggcgggcgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354405 - DNA, 1260 bp, Homo sapiens
tgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccggcgctcccgggccagggcgagcgcggcgaggggcgcaccgaccggttcgcagcggggcgcgggcactctcggggttcacacgccggtccccgcgcggaccgcggacgcgcgcgtcccccccgcgggcggcgccccttacagggccgagtcggagtcgctggagtccaggctgttcctcagtttgcagctgctgagctgctcccgctgcagcgacaggctctgcgtgctgcggcgcaggcactccaggctctgcaggaacgacttcttggccttctcctcctccatgggggacaccccctcctcctccacctcctggatctcgtcgaaggtcaccggctgcgtcttgaagcgagactggcgcggccgcagccggcccggcccttgggcagcttggcgggcgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354406 - DNA, 1027 bp, Homo sapiens
tgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccggcaggcactccaggctctgcaggaacgacttcttggccttctcctcctccatgggggacaccccctcctcctccacctcctggatctcgtcgaaggtcaccggctgcgtcttgaagcgagactggcgcggccgcagccggcccggcccttgggcagcttggcgggcgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354407 - DNA, 767 bp, Homo sapiens
tgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccgggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354408 - DNA, 894 bp, Homo sapiens
tgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgattcttggccttctcctcctccatgggggacaccccctcctcctccacctcctggatctcgtcgaaggtcaccggctgcgtcttgaagcgagactggcgcggccgcagccggcccggcccttgggcagcttggcgggcgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354409 - DNA, 839 bp, Homo sapiens
ttttttttgtgcaattttgtactgccccgactactacgggagccgggccagacatatccaggtaaaaagatcgttaaataaatgccttcagccatcgcaatgcaaaaataaatatcaatcctccagacgcagtagcagccgcggagtcgctggagtccaggctgttcctcagtttgcagctgctgagctgctcccgctgcagcgacaggctctgcgtgctgcggcgcaggcactccaggctctgcaggaacgacttcttggccttctcctcctccatgggggacaccccctcctcctccacctcctggatctcgtcgaaggtcaccggctgcgtcttgaagcgagactggcgcggccgcagccggcccggcccttgggcagcttggcgggcgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354410 - DNA, 1321 bp, Homo sapiens
ttttttttgtgcaattttgtactgccccgactactacgggagccgggccagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccggcgctcccgggccagggcgagcgcggcgaggggcgcaccgaccggttcgcagcggggcgggagtccgagcgcgcgaggagcggcggtcccgggtccttgcgggtcccccgggagcagggcgcgggcactctcggggttcacacgccggtccccgcgcggaccgcggacgcgcgcgtcccccccgcgggcggcgccccttacagggccgagtcggagtcgctggagtccaggctgttcctcagtttgcagctgctgagctgctcccgctgcagcgacaggctctgcgtgctgcggcgcaggcactccaggctctgcaggaacgacttcttggccttctcctcctccatgggggacaccccctcctcctccacctcctggatctcgtcgaaggtcaccggctgcgtcttgaagcgagactggcgcggccgcagccggcccggcccttgggcagcttggcgggcgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354411 - DNA, 1201 bp, Homo sapiens
tgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcactgggaagagttaaaaaataaacatttacaaggacgaggaaagcggccccgctcccgcgggcactctcggggttcacacgccggtccccgcgcggaccgcggacgcgcgcgtcccccccgcgggcggcgccccttacagggccgagtcggagtcgctggagtccaggctgttcctcagtttgcagctgctgagctgctcccgctgcagcgacaggctctgcgtgctgcggcgcaggcactccaggctctgcaggaacgacttcttggccttctcctcctccatgggggacaccccctcctcctccacctcctggatctcgtcgaaggtcaccggctgcgtcttgaagcgagactggcgcggccgcagccggcccggcccttgggcagcttggcgggcgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354412 - DNA, 1052 bp, Homo sapiens
tgcactgtgcaaatatattgactttatttgtctcctttcaggagcctcacagacatatccaggtaaaaagatcgttaaataaatgccttcagccatcgcaatgcaaaaataaatatcaatcctccagacgcagtagcagccgcgctgcgcccaaagtcccaacggccacgcctaacaattataaaagtgttcagcgagagtgttggcgtgagtgtgaatgggtgtgcgctggggggcacggtggagcggtgtgcaaaatcggagttgcaaaccatcggacaagggcatggagtggctacccgccgccgactcagcgcgggcgcgcctccccgcacacactcacagcagagttcgcagagtcgctggagtccaggctgttcctcagtttgcagctgctgagctgctcccgctgcagcgacaggctctgcgtgctgcggcgcaggcactccaggctctgcaggaacgacttcttggccttctcctcctccatgggggacaccccctcctcctccacctcctggatctcgtcgaaggtcaccggctgcgtcttgaagcgagactggcgcggccgcagccggcccggcccttgggcagcttggcgggcgcacgggctgcgggaactcgtcggccaggcacacgaagtgcggcatcaccgcctggtaactggagcagatgcccatcagctcgccgggcttggcggccatggcgcctccggcgtctgcggggccgggcggcggggcgccggggctctccgagggcggccgcaatgcttttttttttttttttttttacaatgagaataatcatccacttatatttccataactctctgcaataaagcactttaagttgggaataaggatgtttgcagacacatgccaattacgtgcggaacaggtgctgaattccaattcctgggagtttcttctttcaaaacaagctgctttcttttgttcagtgaacaagtatgtccaggactgaggtgaccatgcagggagtggaaagggtatgagattcagacttcacccttaatctggctctcctttgccagc

SEQ ID NO: 354413 - DNA, 159 bp, Homo sapiens
tgcgccggggccccccgggaggcagcagccgggggctcgccgggcgggggatccaaatctgctgcggggtggcggcggcctcgcgggcccgggccggcgctcctcgggagggcgggcgggcgggcggactcgtcggggggcacggggctcgggggggtc

SEQ ID NO: 354414 - DNA, 204 bp, Homo sapiens
tccctctctccctcccttctccctcgtcttcctctcctctggtcttctttaaaggcaggggctcactctgttgcccaggctagagtgcagtggcgcgattgcagctcactgaagcctcaaactcctgggctcaagggatcctcccacctcagcctcctgagtagctgggactatgggtacatgcccctacacccctggctaatt

SEQ ID NO: 354415 - DNA, 439 bp, Homo sapiens
tgcaatgtaaatgctatataaattattatactgtattgtttagggaatattgacaagaaaaaaaagtctacatattcagtacaaatacaactatccttttattccccaaatattttcagtcgtggttggtttaatccacagataaggaacccacagatacagagggtggactgtatatgtaaacaacccatataatataccactatttaaacttctttgaactcctgaactctggtatacctttactcctttgtcattttaaatgaactgtgctacacaaattgaaatcttaaattcgatatacctgttgggcacggtggctcacgcctgtaatcccagcactttgggaggctgaggcaggcagatcacctgaggttgggagttcaagaccagcctgacgaacatggagaaaccccatgtctactaaaaatacagaatt

SEQ ID NO: 354416 - DNA, 5508 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 354417 - DNA, 5442 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaatt

SEQ ID NO: 354418 - DNA, 7038 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcataggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccctggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcgactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctc

SEQ ID NO: 354419 - DNA, 4143 bp, Homo sapiens
tttaaaatgtatttttcaagtttcacaaaactaagttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcataggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccctggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcgactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctc

SEQ ID NO: 354420 - DNA, 2144 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccctggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcgactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctc

SEQ ID NO: 354421 - DNA, 5640 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 354422 - DNA, 5550 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 354423 - DNA, 6304 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcgactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctc

SEQ ID NO: 354424 - DNA, 6189 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccagactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctc

SEQ ID NO: 354425 - DNA, 529 bp, Homo sapiens
tggtgctgcggtcgtctagaggatcccttaaggcgaatctggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctc

SEQ ID NO: 354426 - DNA, 283 bp, Homo sapiens
tgagaaagggtaggtgctggcatcctgaggggttccgtggctgcaagaggaaagtgaaaatctctcaggttaccgcaagccaggaaagtttgtatcttctctgcatgtcatcccagaccctcaaaaggccacagatgctgagaaggaagatcagaccctagttaccctgaagagcgagcccttaggacaatgacctgggctggcgtgtatctttcctgcaggctggtcagctgtggcctcacgtctgactgctgccaggacctggcctctgtgcttagtgcca

SEQ ID NO: 354427 - DNA, 384 bp, Homo sapiens
cggccgctgcctcagaaggtgacaggtcccaggattctgggccctggggacctggggaccacatgggggatcccaggaggacccggctccctttgtgctttcaggctggaccagacaactctgagtgatgagatgaggcaggaactgagggccctggagcaggagaaacctcagctgctcatcttcagcagacggtaaggggggacccagaactccctctggctgacccaggcccagggctgagcaggagacagggaaagagccatggggtgagagacaaacacagccagggagaaacccagacaccacagcagccagagtgaggtgcacttgtcagtgcaagtagaatcaaatccccccttgcttcaactcttaacgttagac

SEQ ID NO: 354428 - DNA, 5175 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacaagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 354429 - DNA, 6993 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccctggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcgactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctc

SEQ ID NO: 354430 - DNA, 3671 bp, Homo sapiens
cggccgctgcctcagaaggtgacaggtcccaggattctgggccctggggacctggggaccacatgggggatcccaggaggacccggctccctttgtgctttcaggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgagagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcataggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccctggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcgactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctc

SEQ ID NO: 354431 - DNA, 5495 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctctttt

SEQ ID NO: 354432 - DNA, 7263 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggagggcgcaggggggccgcgccgggcagcccccgaaggccgcatcgcgccccccgcccaagaaggaggcgcctccactggacgagggctgctatctcgaccattttccgcacctctccatcttcatctacgcagccatcgccttctccatcacctcctgcatctttacctatatccatttacagcttgcctgagtggccagcgcgggacggggtgggcgcaggaccgagcggggagggaaagggaaaacggggctcggcattttgtgttttagaacagcgctgcacccccttcatgtagctttcgatgcttgtttctttccgtctttgttgtcactatctttgtctatcagtacgaaagtacaaagtagctgccggcaatgaaataggggtgctgtttgcacctgcaggttaggggtggaggcgtttagaattttggggtgtgattgagccccgtttataattagaatgcccctggacccctaccactctgtgacgtgggggcacgcgcagggatcccatcattttgtgtttggggagctcagagtgcgcccaatcttggaatctttaagggatgagccagacccagacccgcggccttctagagagggtccggcagggagggtcggcgccctggcccggggtgggccggagccctgtgatgctgcatcgcccccaggaggagccagctgtgccccagagttggcgcggccgagagaggacaagagcgcgcagcaggcgaagctggagggcgggactcgactttgttgtcgctgcccggaggagtcgagactggtacccggaggagctgtctcaccaggagaccacgtcctggaagtgtccgggactcgcgggacctgtggctgcagaccccgccggcacgcaggcccagagctggcgcactcctgaggatgagactctgggggccctagccggggtccacgggagggctgtccttggggactctaggatggcttcgttctggcccggctcacttctggagctgtgagacccaagacaaaaggggctgagggatttctcattgacaagagttcgtgcgggaaaaccacctgatccctagggatttgtcatcttaagactcaaaaggcttaataccaggaaccaccttggcaagatatttacccaccggccatctctgtttactcatgaatgttaaatgttaaaacgcagcgctctaaccctgcatattatttacttgcaaatgtctgtaatctgtaattgtgatgcctctgatggaataaattatctttttcagtctcctcactcccctcgcgtttgatctaccccggaaaagacttttctcattcttaaaggtatgcccataggtcggggatggccttccgaaaagcttcagggtcatttattttggcccagagcggcctcccacgccccgaaatgcttccgataccgaaggaatgaatctcactgtgttgccgaacgtcgacgccgtctccggagaagcctttgatcactggccccgcacggcactgacacgccgtggaagggacctccctccgcccgggtggcacgcg

SEQ ID NO: 354433 - DNA, 5418 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 354434 - DNA, 5782 bp, Homo sapiens
acgtttccttcctgctcttgttgactaggcgctgttcttgcttggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggaaggaacaccagccagccgtggaacctcaggtgcaacagagacgccaggagatactagtgcccagcagcctgcggcagtaccaatgaagccagagagggcttggtggatgacaaggaggcctgagtagaccgcaggtgggtctgagaaatgggcttaggtgaggcaggtctttgaaggatttgttcttaatcatatgcgagatgctcaaaaggctggatgcctgcttttgtgggtgaagagcaagaagagaaaacaggttgtacacatacagatgcagatggagagacagagaaaaaaaaggaagaaggcagagaaatgcaccaattcttgagctgtattatctctggaccttgggattgtgggaggctttattttactactgattttgcctacactgttttctcaatttctagttttctacaaagatgatgtgttagctttttcacgcattaagattaaaatttaaaacagaccacacaataaatatttcttttaaaaggagaaatatgccctggggaagctccccacgcagctgagagcctggctggttgcatttcggcttcttaggtgccaagcctactagtgccccggggtcccagccagcggctcgcgtttcctcccccttgcgccgccagtctggttgccatggagacaaaccttgctgcgcagagactgccgagccgcaggcagcggagctggaacccggcgagccagcctctgcaacaggctgggggcggaaggaggagccaggcgaagcggcgcctcagctgagaggaccggcggaccctgcagaggccccctgcccctctggctccgcccccacccgggtcgctagaaatacagccgtagccccgcccaccgcccactgcgctctgacccagacccggctgacccacctacccgcgatcctgcccatggctgacgggctctttcggcgcagaccctggggtctcgagcagattcgcccggaccccgagtccgaaggcctgtttgacaagcctcccccggaagaccctcccgctgcccgcgggcccaggtcggcgtcggccgcgggcaagaaggctggtcggcgcgcgggcgggaggtcactattttacctattcgtgttccttgctacttatccactttaagatttcgttattgttctttca

SEQ ID NO: 354435 - DNA, 1199 bp, Homo sapiens
taatcattgttccctatgttctgtaggccatagatgatctagaaatgaaattccagtttgtgcgaatccacaagccacccccgctgaccccactttatatgggctgtcgttacactgtgtctggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactccaaaaaaaaaaa

SEQ ID NO: 354436 - DNA, 375 bp, Homo sapiens
agaagagttcttaggaccaagacttcctagcctgggagttttaagaggttaagtgttaccattgttaagtgtacagccttttgattttcctttttcatcattgtgcaggacaactggtcagccagttgaccagtcattagttctggccatcacctagtcagtcatgtgacatttgacaagagtgggtagtgcatcacccaaattgtttgggaaattttaataatatgtcatttttattgttttcaaagttgtccattgacatctgcaatattgttttcatgttttatcaaagtgggtaaaaaaatctacaacaggcccatctggattctggcagcatcgctggattttaatctaatctacgatcttttttttttt

SEQ ID NO: 354437 - DNA, 189 bp, Homo sapiens
gcaccagtagcaacaccacagcacccatagccttgggtggggtggggggggggctttggatgccaggaaccaagcaaagaaccgagcaagagtggggggccctggagtgcaacagggatattgcatgcctgctgggaactgcaaacaggggtggagaatgcagtggggccaggaaaacctgcagcccct

SEQ ID NO: 354438 - DNA, 3038 bp, Homo sapiens
gggagtccgtggaggggcatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcaacttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgtttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatcccaataaagaagaatggatcagcttggcctatagaccattccttgatgcttctaggctcaatttgttgcccaggctgggctcaactcctgggctcaagcaatcctcgcacttcagcctctcaaaatattgggattacaggcctgagccaaccgtgcctggccataactctctcctggactgggatcttccaaagtgctgcgggattcttgtcccttctgccagatcagatacgcggccgtaatacacatcctaaacc

SEQ ID NO: 354439 - DNA, 2999 bp, Homo sapiens
gggagtccgtggaggggcatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcaacttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgtttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagcacagttttctgtacttccagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatcccaataaagaagaatggatcagcttggcctatagaccattccttgatgcttctaggatcttcaaagctgctgccggggctttctatgttccccttcctggtcagatcagttatacagtgtacgttaactacaccttcttcaaacccggaaagcaaggcaatccagaaaaaagtggggtttgcacaaccttggcccaa

SEQ ID NO: 354440 - DNA, 1923 bp, Homo sapiens
aacatatggaattggagtaggctatgtaccttgcacctaggcttctatctgaacataagggggaatgaataaagccatcaaaagcaatgaccttgttaagaaaagaaagaaaaggagaatgacagctttgtggccttcaagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgtttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatcccaataaagaagaatggatcagcttggcctatagaccattccttgatgcttctaggctcaatttgttgcccaggctgggctcaactcctgggctcaagcaatcctcgcacttcagcctctcaaaatattgggattacaggcctgagccaaccgtgcctggccataactctctcctggactgggatcttccaaagtgctgcgggattcttgtcccttctgccagatcagatacgcggccgtaatacacatcctaaacc

SEQ ID NO: 354441 - DNA, 1473 bp, Homo sapiens
gggagtccgtggaggggcatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcaacttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtg

SEQ ID NO: 354442 - DNA, 2459 bp, Homo sapiens
acagataagttgaaggcatcttttcatacagagcctctgaaccctttgctgagtttaaaaaaacctcactgcctattaattgtggttgttttgtagttgatactgatttttcttccctactgattcagactttctgcagcagaagaggcagatctgcatttttgttcagagttactagaaacactttaatcaattgtttctgttccagagaccctgtactctgtcctctgctgtataaaacaaggttgaggtagatggaactaattagggggctatttaaaggccagattatctgtgtcagcaggtggagagtgcaaagcattgctgccatacaatatctggcccttgaggaggctttctagaatttccggggctagaggttaggaccaggacagtctcagaggaccaatggaagataagcttcttcagaagtaaattgtcagcaatggctctaagtcttttaaagcatattcccttcctggaaatataatcatggggtgttcctggggagcgtggaattctatgagtttttgatttgaggtgtaggctgggagaggaattacatggttagaattgtataattgggttggtacctaaaaaaacaggaaggagaggccaggtgcggtggttcacgcctgtaatcccggtactttgggaggccgagacaggcagatcacgaggtcaagagctcgagaccagcctggccaacatggtgaaaccccgtctctactaaaaatacaaaaattagctgggtgtggtggcacgtgcctgtaatcccagctactcggtaggctcagtcaagagaatcgcttgaaccagggaatcaggttgcagtgagctgagatcccaccactgcactccagcctggtgatagagcaagactccgtctaaaaaaaaaaaccaggagtgagaaaaataagagtcattgaacttcatttttttaaaaaagaatatcactttgctgtcctttctaatatagcatttccccaattatgtacctgtttattgacattttataatgtaggtaaatttttaatcagtttttaattgatacctaattaacctcgagctcttgtcctcctgccttttttcacttctttactcttgcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgtttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatcccaataaagaagaatggatcagcttggcctatagaccattccttgatgcttctaggctcaatttgttgcccaggctgggctcaactcctgggctcaagcaatcctcgcacttcagcctctcaaaatattgggattacaggcctgagccaaccgtgcctggccataactctctcctggactgggatcttccaaagtgctgcgggattcttgtcccttctgccagatcagatacgcggccgtaatacacatcctaaacc

SEQ ID NO: 354443 - DNA, 391 bp, Homo sapiens
aagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatgaa

SEQ ID NO: 354444 - DNA, 523 bp, Homo sapiens
ttaagcatctctagaattataaatggtcacattttctgatatattgtagggatggtggctgtcagagttctgaaatacacgtctgtttctccttatggtagatgatttctttgtttcctttcaagatcaatttaaagataattcttttctgtccagctatttgtatttttaattctagctacattataattatttactatcttaagttagaaaagttatttttgtgtgtgtttaaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaaga

SEQ ID NO: 354445 - DNA, 2615 bp, Homo sapiens
gggagtccgtggaggggcatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcaacttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatgaacttggacttattagccatgcttgtctggtgtatctctgactggagaatgttgtggacgtttgataaccgtttcctgaaaaattttgtccctggcaaaatagaaccctttaaaagtcattctctgtatcctccatgttatgtgcatgatgttagtttttggatagatcagaagaaaggatttgatgaactagagtttcacactgtggcccgagcagtgtctcaggacactattatatccatacagtttcttagccgtttccagcatccaaagactcaacaggtcagtctctgctatagattgacctaccagacctgtgacaaggccctcacccagcagcaagtagcatcaatgcagtcccagtttaggaaggagattcaacaacacctatatgttatacctcggtagtttggtaaatccttttctgcagtgtgatccttcattgcgggggatgtggaggaaaattaccaacttgcaaccagtagtcctttctggatttttgtttttgtaaaatcttttactttgtgaccatagctactgttcgttgatctttttttttttttttttttgagacggagtcttgctctgccgcccaggcgggagtgcagtggcagtggcatgatatcagctcactataagctccacctcccaggttcatgccattctcctgcctcagcctcccgagtagctgggactacaggcacctgccaccacgcctggctaatttttttttttgtatttttagtagagacgaggtttcaccgtgttagccaggatggtctcaatctcccggcctcgtgatctgcctgcgtcggcctcccaaagtgctgggattatagatgtgagccaccgcgcccggcctactgttagttgatcttaaagataccttgactctattactgaaacttatagattataatgtgattggtgacatttggagttgtgtaatattttggtcccgagaagtgactaaaacaataaacaaaacagcatcttgtactttagatgctctattgttgaacaggcagtagaacttaagtgtctcatcaaatataaatatgttttccacactgtcaattactcttcccttaactttgttgtatcatttcattaaatcaccttatgagagt

SEQ ID NO: 354446 - DNA, 1982 bp, Homo sapiens
agccaaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgtttgtataatgtctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatcccaataaagaagaatggatcagcttggcctatagaccattccttgatgcttctaggctcaatttgttgcccaggctgggctcaactcctgggctcaagcaatcctcgcacttcagcctctcaaaatattgggattacaggcctgagccaaccgtgcctggccataactctctcctggactgggatcttccaaagtgctgcgggattcttgtcccttctgccagatcagatacgcggccgtaatacacatcctaaacc

SEQ ID NO: 354447 - DNA, 2225 bp, Homo sapiens
  misc_feature (2021)..(2021): n is a, c, g, or t
  misc_feature (2032)..(2032): n is a, c, g, or t
  misc_feature (2035)..(2036): n is a, c, g, or t
  misc_feature (2046)..(2046): n is a, c, g, or t
  misc_feature (2050)..(2050): n is a, c, g, or t
  misc_feature (2054)..(2054): n is a, c, g, or t
  misc_feature (2062)..(2062): n is a, c, g, or t
  misc_feature (2071)..(2071): n is a, c, g, or t
  misc_feature (2082)..(2083): n is a, c, g, or t
  misc_feature (2088)..(2089): n is a, c, g, or t
  misc_feature (2101)..(2101): n is a, c, g, or t
  misc_feature (2106)..(2106): n is a, c, g, or t
gggagtccgtggaggggcatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcaacttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgtttgtataatgtctttactcctcatggacctgatctttatggtncagaacctggnttnnatttaattangggnttcngatttcangtgccttgnttgggctcctnntctanncgggttctttgnaacgnggggatttgttgagtttgggccgcgtggttccgggcgcagttttggaaaattcgcccaacggggccggcacaaaatgggggcctgtaaaaagtgtccgaagcaggtgaaagttctgcga

SEQ ID NO: 354448 - DNA, 2758 bp, Homo sapiens
gggagtccgtggaggggcatggcccctcggcgcctcctgttggttggggaggggaatttctccttcgccgccgctctgagcgaaaccctggatcagagcactcaacttaccgccacctgcctccagcgcccggccgagttggctcgggatccactggcctgggagaatctgcagtgcctgcgcgagcgaggtatcgatgtacgtttcggtgtggactgcacccagctggcagatgtctttgaactgcacgagagagaatttgatcaaatttatttcaacttcccgcattgtggacgcaaagctggcgtagctaagaacagggaactgcttgccaaatttttccaaagctgtgcagacgttcttgcagaggaaggagaagtccacgtggcattatgtagaggacaaggtggaactcctgcggataagccccagagagaatggcacaacagttggcaagtggttgccatggcagccctgggggggctcattttaagcgacgtgtatccattcagctgtaaggctgtggcagggtacaagtgcactggatataggagtcaagataagtcctttcatgtagaaggtgctttgaaccatatcttcaccaggagcttaccttttgaaggttctcaacccagaatcttcaggatcaaactgggtaaccagtggttttcctttccagaaccagaagcacttgtaggaaagttgaacaggggtttcctggaagcaccttcatgtcatcctatcaaaaccataaatgagaaactcattgctgaattaggcaaagttttcccgctaaaaaggctgaagtgttcctaccctttgctgccacaggaaggtaccagtgttcttcctttctggaattgtgactttctgtcagctgctttttggattagtctccatgaagataactcaaattctgagtccctgactggtgggacatcacaagatgtggaagactttctagtgtcattttcagaacttagccttctcaagaatcctggaagagatggtaaagaagaagcttgtgaaggaacctgtggccaggccaagatctgccttagaccttctctcctagtgcatgttcaggatgtcatcgaagtaccagacttcctctcaggttctctgcacatcctcagtggacctgtctttcagaagtgccacattttgcctttcacaatgccagcatttcatgaaactttatttatccttggggttaatcaaaatctgaaggatggctgtcttcaatcactgctggatcatctgaagggcattctagatagcctgctgacccagacattgccggagagctctaagctgagcagtttagtcaaatttgtccttcagtcaaatggaaaggattatatgattcgtgtgaagactcataattttagcccagattgtactgaggatctaattattgggtctgttatcacatctgccactagtgttatacataaagaccagtgttttgtgtttgtgtctatgaacttggacttattagccatgcttgtctggtgtatctctgactggagaatgttgtggacgtttgataaccgtttcctgaaaaattttgtccctggcaaaatagaaccctttaaaagtcattctctgtatcctccatgttatgtgcatgatgttagtttttggatagatcagaagaaaggatttgatgaactagagtttcacactgtggcccgagcagtgtctcaggacactattatatccatacagtttcttagccgtttccagcatccaaagactcaacaggtcagtctctgctatagattgacctaccagacctgtgacaaggccctcacccagcagcaagtagcatcaatgcagtcccagtttaggaaggagattcaacaacacctatatgttatacctcggtagtttggtaaatccttttctgcagtgtgatccttcattgcgggggatgtggaggaaaattaccaacttgcaaccagtagtcctttctggatttttgtttttgtaaaatcttttactttgtgaccatagctactgttcgttgatctttttttttttttttttttgagacggagtcttgctctgccgcccaggcgggagtgcagtggcagtggcatgatatcagctcactataagctccacctcccaggttcatgccattctcctgcctcagcctcccgagtagctgggactacaggcacctgccaccacgcctggctaatttttttttttgtatttttagtagagacgaggtttcaccgtgttagccaggatggtctcaatctcccggcctcgtgatctgcctgcgtcggcctcccaaagtgctgggattatagatgtgagccaccgcgcccggcctactgttagttgatcttaaagataccttgactctattactgaaacttatagattataatgtgattggtgacatttggagttgtgtaatattttggtcccgagaagtgactaaaacaataaacaaaacagcatcttgtactttagatgctctattgttgaacaggcagtagaacttaagtgtctcatcaaatataaatatgttttccacactgtcaattactcttcccttaactttgttgtatcatttcattaaatcaccttatgagagtagtttttggcatcagactaacatttattagcttgggaaattgcaaatattccacattaattttggtattattattataatcatcaccattttaattctgtggttgaaagtcatggaacgaataaagtgtcagatttagggtta

SEQ ID NO: 354449 - DNA, 383 bp, Homo sapiens
caattttctaaagggattgtttgcttctttactgttgagttttgagagttctttttatattgtagatactagccttttgtcgaatatgtcatttacaaatattttctcgcagcctatagcttgtcttttcacagagcaaaagtttctaatgatcaaatttcccgtttatgaattgtggtttttatcttctgaattctttttgcctagtcttaatcccaaatatatagtcctaggtttttccctagaagcattatagttttacacttcacatttaagtcaatgatccatccatttggagttaatttttgtactaagtgtgatttaggtccaggttccttttttggtttttgtttgtttgtttttgctattggatgtcctatggc

SEQ ID NO: 354450 - DNA, 382 bp, Homo sapiens
tttttttttttcataaagacagggtcttgctatgttccccaggctggacttgaactctcagactcctgcctcagcctcccaagtagctgggactacaggtgtgcactacttttgttgttttttttgttgttgtagagatgatgtcttgctatgttgcccaggctgatctccaactcctgttctcaaatgatcctcccaacgtggcctcccaaagagctgagattgcagatatgagccaccttgctcagtcctcagacttctttgctttttatttcacctgatgctgttgttgttttcaaatagatgagtttaatccatttcacttggagttatgttactatcttattcagtattttgtctactattttttctgtattttttt

SEQ ID NO: 354451 - DNA, 1169 bp, Homo sapiens
gcagcagcagcagctgatgatgaagagagaggcagtggcagagggggggcaccttttatttctatttttaaagggacaggacactaattctaccccacttcaaccttgaattcaggggggtggggggaaggcggctgagttccttcccccaccctccagccctgagccctgagagggggattgagcctgagagaggagaaggagtttcttcttcttcgaaaacccccatccacgactcctaccccctcacccctccaactcgcctccctccctccaccctcctcctctttggccgtgagaggaggagagaaagaaaccaaaagcctcttagcaacacagaccctttgctgctgctgttgctgctgctgctgctgttgctgctgctgctgctactgctgctgctgctactgctgctgcttggccctggctggagacatctcactacacccaggagcagccacttccccagctctcctcctcctccttcgcctcctcctcctccactccccccctttattaccctttgtgtcatcctccacagctccagggaaggcactcaaaagtggggggcaggaaaggatcgttaaacaccagttcagcgggagttggagggctgacgacactacagaatctggactctatgacttgttttgggagtaacaggagggtgtgatgaggaatttctgtgaaggtgacttctggatcctcagcttcaattactgaaactatggagagacatgaaagcaccccaccctggctcaggtcaggaaagaattaggaaaggggacttctgactggttaggtgaaattgaggaagggttagaagttcaggaaagtaatacttaaaagtagcagattgtatagacactcttgttctgaagtaccttgaaatggatttggagaagaaccaccatcaggccatcatggatgatctttctcaggagaaagatgagaaccagtttacaacaggccatctagtttaacagctttcactcttgtacctgtacacacgttacacacttatgcatactcatgtacatcatacacacaaacactcgttattctaaagcaagtaagatgatgcagagattgattactggggcaaaagaaggttctgccttggtcttcactgcctttcttctgctttccacccatctttcctctctcca

SEQ ID NO: 354452 - DNA, 749 bp, Homo sapiens
aacctccgggcttaagtgatcctctaacctcagcctcctgggactaaaggctcatgccaccatgcccagcttatttattgaagtccagccagtatcgagaattactgtgctagggctatgatcccctgtgttaacattttcttaccttgctcttgaaggatcgttaaacaccagttcagcgggagttggagggctgacgacactacagaatctggactctatgacttgttttgggagtaacaggagggtgtgatgaggaatttctgtgaaggtgacttctggatcctcagcttcaattactgaaactatggagagacatgaaagcaccccaccctggctcaggtcaggaaagaattaggaaaggggacttctgactggttaggtgaaattgaggaagggttagaagttcaggaaagtaatacttaaaagtagcagattgtatagacactcttgttctgaagtaccttgaaatggatttggagaagaaccaccatcaggccatcatggatgatctttctcaggagaaagatgagaaccagtttacaacaggccatctagtttaacagctttcactcttgtacctgtacacacgttacacacttatgcatactcatgtacatcatacacacaaacactcgttattctaaagcaagtaagatgatgcagagattgattactggggcaaaagaaggttctgccttggtcttcactgcctttcttctgctttccacccatctttcctctctcca

SEQ ID NO: 354453 - DNA, 694 bp, Homo sapiens
gcagcagcagcagctgatgatgaagagagaggcagtggcagagggggggcaccttttatttctatttttaaagggacaggacactaattctaccccacttcaaccttgaattcaggggggtggggggaaggcggctgagttccttcccccaccctccagccctgagccctgagagggggattgagcctgagagaggagaaggagtttcttcttcttcgaaaacccccatccacgactcctaccccctcacccctccaactcgcctccctccctccaccctcctcctctttggccgtgagaggaggagagaaagaaaccaaaagcctcttagcaacacagaccctttgctgctgctgttgctgctgctgctgctgttgctgctgctgctgctactgctgctgctgctactgctgctgcttggccctggctggagacatctcactacacccaggagcagccacttccccagctctcctcctcctccttcgcctcctcctcctccactccccccctttattaccctttgtgtcatcctccacagctccagggaaggcactcaaaagtggggggcaggaaagatgtacattgaagatgtcagtttctacatgtgggaagtagacattgaaggctttatggtttacagacaagatctttagaagataagcactaaaggtaagtagtaactatagcccca

SEQ ID NO: 354454 - DNA, 1173 bp, Homo sapiens
gcagcagcagcagctgatgatgaagagagaggcagtggcagagggggggcaccttttatttctatttttaaagggacaggacactaattctaccccacttcaaccttgaattcaggggggtggggggaaggcggctgagttccttcccccaccctccagccctgagccctgagagggggattgagcctgagagaggagaaggagtttcttcttcttcgaaaacccccatccacgactcctaccccctcacccctccaactcgcctccctccctccaccctcctcctctttggccgtgagaggaggagagaaagaaaccaaaagcctcttagcaacacagaccctttgctgctgctgttgctgctgctgctgctgttgctgctgctgctgctactgctgctgctgctactgctgctgcttggccctggctggagacatctcactacacccaggagcagccacttccccagctctcctcctcctccttcgcctcctcctcctccactccccccctttattaccctttgtgtcatcctccacagctccagggaaggcactcaaaagtggggggcaggaaagacaattatcaactttccagttttctatggatatgaagatttactcctagtcatcagtgggacccccatgaagtcagccagaaagcctatatccaacttatgtacctttgcaaacttgtctggattttgactgtatgtgcaaaacagattgtacttagcgattcattaaacatcttttgatcatctgctgtctgccaggcactgtgctaggcatctgaaaaacaaagatggtccctgcagtttaatgtgaagagctatcttaattgtattccacaagtgtattggtcgtatctttgttttggtgtttctacctaaataaattttatattaactaaatggatactgttaggtggaaaaatgcatgtttaagaaagatattgctgttattttattaaaatacaaatatataaagaaaaattttccacttaatactgtattctagggatttatattctgtatatagttaacacattttagacaatgaaaatagcctatgtggttgcctttgctggatttttattgctaaccgtaattcttttaagatgaccaacaatgttcattaagttatctcattaaatttttccaaaaaaaaaaaa

SEQ ID NO: 354455 - DNA, 518 bp, Homo sapiens
gaataagcaataatgatccaacacattccagttaaaaatatacttgtaaaaattgttcaggatgcacttaaatttcattgaccggtgcaataggttgttggaatgattaggccgcttttaccagctctataaaacaagtgctacttaggtgacatgtttccctgactttgtttttttggtccttacccagacaattatcaactttccagttttctatggatatgaagatttactcctagtcatcagtgggacccccatgaagtcagccagaaagcctatatccaacttatgtacctttgcaaacttgtctggattttgactgtatgtgcaaaacagattgtacttagcgattcattaaacatcttttgatcatctgctgtctgccaggcactgtgctaggcatctgaaaaacaaagatggtccctgcagtttaatgtgaagagctatcttaattgtattccacaagtgtattggtcgtatctttgttttggtgtttctacctaaataaattttatatt

SEQ ID NO: 354456 - DNA, 208 bp, Homo sapiens
ccgcccagcccaaccctggggctggggcatggcgtgcagcgagagtcttattgaaccttctgggtactttcccctttgttcctccccgatctagagaggcccaaattctggctgtgatccagctctcatgcccctcctagccctgctcctgctgtgtgaccctgggagagtgacctaacctctctgagccacaaatgggataatagca

SEQ ID NO: 354457 - DNA, 331 bp, Homo sapiens
gaaacactgccatctcctggggagatcaagcaattgacagcttgtgcaacatggcagtttttgttcagcactacaaaagactgctgtctctttcaaatcccagtgtctgtaagaaactgtgggaacttttctgtatacttactacaaccaactcagggatgtatgggctactgtgcggaagggttctttgccaagattgtaaagtccccccacacgtgaaagcatcaaaacagacatctcacatttttccactggacataatgattgagtgtgttaaaaattctttggtttcctcaagtccattcctgttttaattaaaggatgaagaagg

SEQ ID NO: 354458 - DNA, 483 bp, Homo sapiens
tttcacctcttttgcctgtttggaaataattatcacaatcattactgaattatacaataaaataaaacttttcttggtctaaaggtaggcaagctttttctgtaaaggctcagatggtaagtgttttaggctttgcaggctatatgttttttgttgtaactactcaaacctgttattgtagcgaaaaaaagtatataggcaatacataaatgaatgagttccaaaaatacttaatggaaaccaaaaatttgaatttgatacaatttccatgtgccatgatatattgttcttttttaaattttttgacatttttggggggagaatcagggacagactggaaatttttcaaccatttaaaaatgtagaaactatggggcatggtagtccatgtctgtgatcccatgggaagatcgcttgaggctgggagtttgagagcagcctgggaaccatagcaagtcccctcctctaccaaaaaaaaaaaaa

SEQ ID NO: 354459 - DNA, 6795 bp, Homo sapiens
ccgccgaactcagaggccggccccagaaaacccgagcgagtagggggcggcgcgcaggagggaggagaactgggggcgcgggaggctggtgggtgtcgggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattcgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcaccggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttatactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaattcatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccattt

SEQ ID NO: 354460 - DNA, 223 bp, Homo sapiens
taccttgtgacgctctagagatcccccggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagggggatcctctagagtcatccacag

SEQ ID NO: 354461 - DNA, 6247 bp, Homo sapiens
taccttgtgacgctctagagatcccccggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattcgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcaccggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttatactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaattcatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccattt

SEQ ID NO: 354462 - DNA, 6249 bp, Homo sapiens
gattgacgaattgcgagctcggtgaccccggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattcgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcaccggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttatactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaattcatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccattt

SEQ ID NO: 354463 - DNA, 1934 bp, Homo sapiens
ccgccgaactcagaggccggccccagaaaacccgagcgagtagggggcggcgcgcaggagggaggagaactgggggcgcgggaggctggtgggtgtcgggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctccaatatcttcttcaggctctgacaggcctcctggaaacttccacatatttttcaacgggcccggtggttaatataaaaagtccttgcacgttaagtaggaaaatggtggtgtcaaaaccctggactgggttagcatgtgacctgggaaagcgc

SEQ ID NO: 354464 - DNA, 6083 bp, Homo sapiens
actgtttgtttgcctttagtatagatgttatggaaagatacactgtatatatctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattcgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcaccggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttatactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaattcatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccattt

SEQ ID NO: 354465 - DNA, 5642 bp, Homo sapiens
atattgaagtattgggccggtaatgttcatttcgtacgcggcggttgttcggcctcctgcggcttttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattcgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcaccggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttatactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaattcatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccattt

SEQ ID NO: 354466 - DNA, 1244 bp, Homo sapiens
atattgaagtattgggccggtaatgttcatttcgtacgcggcggttgttcggcctcctgcggcttttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccattt

SEQ ID NO: 354467 - DNA, 781 bp, Homo sapiens
atattgaagtattgggccggtaatgttcatttcgtacgcggcggttgttcggcctcctgcggcttttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctccaatatcttcttcaggctctgacaggcctcctggaaacttccacatatttttcaacgggcccggtggttaatataaaaagtccttgcacgttaagtaggaaaatggtggtgtcaaaaccctggactgggttagcatgtgacctgggaaagcgc

SEQ ID NO: 354468 - DNA, 6502 bp, Homo sapiens
gtcatgtattaagacgagcaaattactaatggaagtttatcccggatcatcgaactatttccgtattcacgcgaccgtctctgacagttatttcataagacagattatgggtataagatggttgtacatttagaaatgtcgtgggtagtacggctaaggtatatattaataatactactacgaataattaatgctgtgtgatggtggatagatataagaaattaattgtatatagtaatatttattgtcacgtaggggagggataggggtgggcgcgtgtggggtagttgggtgaggttttgaaatgtttgttgagtttgtgcagtgtgatggatattggtaggggcggtttgcccagtggagttggtgttgggacgcggggggcggtgtggcgcgggggggaggggctcgaggaggctagagtaataaggttaaagtacgatgttgtggcggtggtttatgattgtcgtgtggataaaggtaggtatggaatgtgagtaaggatacaggggggatgcggaagtttatcagataaataatattgtgataatcaggtaaatagcgggtaaaggtggacgggacaagagagcatggacgagaagaggagtatttttctaggaaagtgacgatggttagttggatgtgctttagatagggtggagtaaaagggggatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattcgtctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcaccggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggttttcctggtgtttccctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttatactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaattcatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagatacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtgttttcttgtctcccattt

SEQ ID NO: 354469 - DNA, 771 bp, Homo sapiens
ccgccgaactcagaggccggccccagaaaacccgagcgagtagggggcggcgcgcaggagggaggagaactgggggcgcgggaggctggtgggtgtcgggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagggggatcctctagagtcatccacag

SEQ ID NO: 354470 - DNA, 457 bp, Homo sapiens
tgtaatcctttgtggaagcctccctgtttcccttctctgatctgccccggagattcctgtgtgtcccagtctctagggagggaggcttagctggagaggttcagggcaggagaaagcaggagaatgcagaggccgcggggagaggacagaaagtatatcatttataactaacctttagcctttagccactcaaaaatatttcctaatagcctaagggttcttggcaggtctttccccacatcagcaagaaatcttgggagttgggaagagtcagaccttgttccctgaacaagctttctgctttggccaagagttgttaggagattaatgcctgtccccgaaaggcacaggttggagtgtttacttcttcctctcctttcctctctccccccttagagatcgtgacccttcctgcttgcctccctggtgggctctttcaggctggacacagggttta

SEQ ID NO: 354471 - DNA, 1043 bp, Homo sapiens
ggagggtcagctcgttgcaccctggcccggcctcttttcgaccctgcggagcatccgcttccggttcccagactgaattgtcagtgagcggagtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 354472 - DNA, 1166 bp, Homo sapiens
cgtggtcgtataggtcgctgggttcgtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaaacaacacaatccaaccacaccgccacacacaaaaaagggggggggtaaaaatacccacggggggccaacgttcactggcccacttttttggcaacaggggccctaaggggggctttaacacaaacgcgggggttaacacggtcgatggaaaagtgcttttggtttgggaggcccttgggggggaattggc

SEQ ID NO: 354473 - DNA, 1233 bp, Homo sapiens
ggagggtcagctcgttgcaccctggcccggcctcttttcgaccctgcggagcatccgcttccggttcccagactgaattgtcagtgagcggagtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaaacaacacaatccaaccacaccgccacacacaaaaaagggggggggtaaaaatacccacggggggccaacgttcactggcccacttttttggcaacaggggccctaaggggggctttaacacaaacgcgggggttaacacggtcgatggaaaagtgcttttggtttgggaggcccttgggggggaattggc

SEQ ID NO: 354474 - DNA, 1282 bp, Homo sapiens
ggagggtcagctcgttgcaccctggcccggcctcttttcgaccctgcggagcatccgcttccggttcccagactgaattgtcagtgagcggagtctgaggtcgctgtggactgcccactggattgtgaaaaatgaggtcctctttctagagtacctgacaggttgcttggcatccagaagatgtttagctaagttaagagttttcttctgtcttccttctctcctccaaccttaacacctagatatgggctgggcctgtagactgactgccttggaatgggttggagctgctgtctgaaacttgctgggctgctctcccttttgaaccactttttgtctgttctgattcactcttccagggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 354475 - DNA, 1034 bp, Homo sapiens
agagggcgacaacgcagcgccactcttacgggaattcccttcacctcttccttcatgatcctatctcagcaccgtctctgcgagggggaaaaagaaggctcgctgatgaatggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 354476 - DNA, 1045 bp, Homo sapiens
ggagggtcagctcgttgcaccctggcccggcctcttttcgaccctgcggagcatccgcttccggttcccagactgaattgtcagtgagcggagtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactcaggtggtgtgcacaccacctgagtcctcaggaaactcacttaagggggtttgcctttgcctagtgaagcaattat

SEQ ID NO: 354477 - DNA, 1026 bp, Homo sapiens
aaaaaaaaaaaggtgaagaaatggggagctactgggctgccccagtgctatccatctactcatttagtctgtgttatctgttctacttaaattaagtctatgacctttccttttcctgacttcagggtaattcattagtgtttcagatgaaggtaggtgtgaagtaagactggtaaaatttctggggttgctgtgtcttgcagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 354478 - DNA, 976 bp, Homo sapiens
cgtggtcgtataggtcgctgggttcgtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 354479 - DNA, 1115 bp, Homo sapiens
ggagggtcagctcgttgcaccctggcccggcctcttttcgaccctgcggagcatccgcttccggttcccagactgaattgtcagtgagcggagtctgaggtcgctgtggactgcccactggattgtgaaaaatgaggtcctctttctagagtacctgacaggttgcttggcatccagaagatgtttagctaaggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 354480 - DNA, 1021 bp, Homo sapiens
ttgagacggtaacatctgttttgcaggattgtgaaaaatgaggtcctctttctagagtacctgacaggttgcttggcatccagaagatgtttagctaaggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacaattatcatcgccaaaaagagaggactgtgcactagaaagttgcagcccacagcccttcatgtggactctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 354481 - DNA, 977 bp, Homo sapiens
ggagggtcagctcgttgcaccctggcccggcctcttttcgaccctgcggagcatccgcttccggttcccagactgaattgtcagtgagcggagtctgaggtcgctgtggactgcccactgggccttgcccgagatggacagccggattccttatgatgactacccggtggttttcttgcctgcctatgagaatcctccagcatggattcctcctcatgagagggtacaccacccggactacaacaatgagttgacccagtttctgccccgaaccatcacactgaagaagcctcctggagctcagttgggatttaacatccgaggaggaaaggcctcccagctaggcatcttcatctccaaggtgattcctgactctgatgcacatagagcaggactgcaggaaggggaccaagttctagctgtgaatgatgtggatttccaagatattgagcacagcaaggctgttgagatcctgaagacagctcgtgaaatcagcatgcgtgtgcgcttctttccctacatctgtcatgacatgctaactagacttcaggggagccacttctgttttcagcccctccctggaatagtgagttgggaggatggggagacagctaaccaactgcattacccaaaccatattgcacttttagttccctagttttctaggtgagcttcattccctgaaaggaggatgatgatatctaggcataacctagcctgtgaggaacctagttaggaaagacaactgacatttattgaatatcatgcactagtcccttacatatgtcatattttaattatagaaatcagtagcaaaaagaatcttggggattttccatctgacttccctggccatcttatcccatccttgcactaccagaagattcatacacttttgagactccagtgagacgctgttttcaccccttcctcctcctagcctctctcccaaaaagtaaaacacaatgctgaagaaa

SEQ ID NO: 354482 - DNA, 2065 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacgggaccttaaggcctctgtgtggcagaaggatcagctggtgacacagccgcactggcaagaaaatggacccaccttttccagcacaccttaccgctaccaggcctgcaggtttgggcaggttccagaccagcctgctggcctgcgactcttcacagtgcaaattccccacaagcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354483 - DNA, 2196 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcaggtgtgagacattgctgccttggctagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354484 - DNA, 2306 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaaaaacacaacactctaaccaaactccgagggactcaatgtcgggtgcgggccacacgacgcctactcgcacggccctgtggcctatagtgttccgtgccccagtttcgtgcccaacgggtacatctcccggtcccct

SEQ ID NO: 354485 - DNA, 1996 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354486 - DNA, 2735 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtggtgagagcgcagggccactggggctgggtcttgctgcgggctggcggcgattccagggtggccggggggtcgcggggcgggccacactccagcttcgggccctgcccacttctgttgggaagacccgcttgcctgacgcccaggggcgaatttcagtcgagaactcagcgggcggaggagaggcttttaaggtaaagtgaaaactgcacacagctgcagagtcgccaggaacgcttcagctccgcctcagagcagctccaggggtcttatactggccttttccgggaggtcttgcctgccctctagcagcggcgagagtggtgcatttgggtttaggctaagttccttccctctcctgagcttcaccctgttctgtaaaatagaggtaataatcccagtcctgctcactgtgtagatttgtgaggcccaaatgagagaaaaaagactcgagaaacccttgtgaactagaacgtgcagaaagcaaaggggtaagacatcagactcttccctaaacgtgctctctgggcacccctgaacttgctcatccgggttccccctcccacagcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354487 - DNA, 2103 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354488 - DNA, 1093 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccacctttctgcagtggatcggagctaaagtctgtctgcaccgcctgcaaattctctaccctgagttctagcccctcgtgctgggtttccgctccacatttcttcgtcgacgcggccgcgaat

SEQ ID NO: 354489 - DNA, 1679 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaaaaacacaacactctaaccaaactccgagggactcaatgtcgggtgcgggccacacgacgcctactcgcacggccctgtggcctatagtgttccgtgccccagtttcgtgcccaacgggtacatctcccggtcccct

SEQ ID NO: 354490 - DNA, 2170 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354491 - DNA, 2302 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtggtgagagcgcagggccactggggctgggtcttgctgcgggctggcggcgattccagggtggccggggggtcgcggggcgggccacactccagcttcgggccctgcccacttctgttgggaagacccgcttgcctgacgcccaggggcgaatttcagtcgagaactcagcgggcggaggagaggcttttaaggtaaagtgaaaactgcacacagctgcagagtcgccaggaacgcttcagctccgcctcagagcagctccaggggtcttatactggccttttccgggaggtcttgcctgccctctagcagcggcgagagtggtgcatttgggtttaggctaagttccttccctctcctgagcttcaccctgttctgtaaaatagaggtaataatcccagtcctgctcactgtgtagatttgtgaggcccaaatgagagaaaaaagactcgagaaacccttgtgaactagaacgtgcagaaagcaaaggggtaagacatcagactcttccctaaacgtgctctctgggcacccctgaacttgctcatccgggttccccctcccacagcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggtgaggagctccctctctacccccttggggaaagggttgaacgagtaaggtcactcttggtgtctctaaagaagtgggtctggaagtagggttttggtagcaagctagaagttgtatgggcacctgccatggagagaggggccagtactccttactgtagaagcctggaacctggccaagtgtttgtgttacaggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354492 - DNA, 2603 bp, Homo sapiens
  misc_feature (2171)..(2171): n is a, c, g, or t
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaanaaaaaaaaaaaaaaaaaaaaaaaaaaaaacaacacgtggtgggcgcgcggcccggggcccccggaagaacagcttcctcaagaaccaatcgcgggggggcgcgcgcgggggcccaagggaggaaaggggcaacacgggcggcaataaggagggtcccataaagagagaacaccggagggacaaggagacaaggcggcgcgggagaatctctcccaccaaaataaacaagacgcgcccggagggcgaaccccgagagggcgctgcggagagacacaaactctccaaagcagggagggcggttcacccgaggggggcgcaacacagaggggggcgccctataacataaagcgagggaggagcccacaaaaagagcagaaggctcacaaaatatatcaaaaatatatcggcgcccccgcacccgcgggggggggg

SEQ ID NO: 354493 - DNA, 2238 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacgggaccttaaggcctctgtgtggcagaaggatcagctggtgacacagccgcactggcaagaaaatggacccaccttttccagcacaccttaccgctaccaggcctgcaggtttgggcaggttccagaccagcctgctggcctgcgactcttcacagtgcaaattccccacaagcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354494 - DNA, 2929 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtggtgagagcgcagggccactggggctgggtcttgctgcgggctggcggcgattccagggtggccggggggtcgcggggcgggccacactccagcttcgggccctgcccacttctgttgggaagacccgcttgcctgacgcccaggggcgaatttcagtcgagaactcagcgggcggaggagaggcttttaaggtaaagtgaaaactgcacacagctgcagagtcgccaggaacgcttcagctccgcctcagagcagctccaggggtcttatactggccttttccgggaggtcttgcctgccctctagcagcggcgagagtggtgcatttgggtttaggctaagttccttccctctcctgagcttcaccctgttctgtaaaatagaggtaataatcccagtcctgctcactgtgtagatttgtgaggcccaaatgagagaaaaaagactcgagaaacccttgtgaactagaacgtgcagaaagcaaaggggtaagacatcagactcttccctaaacgtgctctctgggcacccctgaacttgctcatccgggttccccctcccacagcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggtgaggagctccctctctacccccttggggaaagggttgaacgagtaaggtcactcttggtgtctctaaagaagtgggtctggaagtagggttttggtagcaagctagaagttgtatgggcacctgccatggagagaggggccagtactccttactgtagaagcctggaacctggccaagtgtttgtgttacaggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaagttgtgtgcttcaaccacgataataccctgcttgccactggaggaacagatggctacgtccgtgtctggaaggtgcccagcctggagaaggttctggagttcaaagcccacgaaggggagattgaagacctggctttagggcctgatggcaagttggtaaccgtgggccgggaccttaaggcctctgtgtggcagaaggatcagctggtgacacagctgcactggcaagaaaatggacccaccttttccagcacaccttaccgctaccaggcctgcaggtttgggcaggttccagaccagcctgctggcctgcgactcttcacagtgcaaattccccacaagcgcctgcgccagccccctccctgctacctcacagcctgggatggctccaacttcttgccccttcggaccaagtcctgtggccatgaagtcgtctcctgcctcgatgtcagtgaatccggcaccttcctaggcctgggcacagtcactggctctgttgccatctacatagctttctctctccagtgcctctactacgtgagggaggcccatggcattgtggtgacggatgtggcctttctacctgagaagggtcgtggtccagagctccttgggtcccatgaaactgccctgttctctgtggctgtggacagtcgttgccagctgcatctgttgccctcacggcggagtgttcctgtgtggctcctgctcctgctgtgtgtcgggcttattattgtgaccatcctgctgctccagagtgcctttccaggtttcctttagcttccctgcttcctgggaatcaggagcctggacactgccatctctagagcagagtggaggcctggactccctttgctcactccattcgggtccacagctgaggttgcctctgacaagatgaatgggcactgcctgcccttctagtgaaaaggcttggctatggccctgtgtgactccaggtcccaggaaccttgccttcgtcatctgtggatccatccagaacagcggtatctgaagcccaggccatactccctgcctcctttcttctgcctaccagaggctccagagttgagcttgtccttatctagaaacatgtgaagatgcccaagagcctggaggcactgctgtccttcctgcagaaacagtttctcctcctcccctcagccttgtggccagttcctcttcacatgaagcccctggcatttgctggggaagggactggcctggtacttgctgttagggcaggaaggggcaaaaggaagacttgggtagtaatctgggggttcagatgggtagcactaagccagctggcctaaagatgcaataagttcctaggtagtctacccttaccttgaggaatgggaaaatgaacctcagcccattaggcaggaaaagttgatatttaataaacaaggaaagagtgaactgagaccccaaa

SEQ ID NO: 354495 - DNA, 847 bp, Homo sapiens
tgcgcctgcgcggagggagccgcgagacaggtgcgcatgcgcagtgcgcgtctgcgagaccgacttggacggagccgagctgaggctcggcttcctgctgatggtcagggttttggcaactccccggtgtgagaggggtagggagtgctcccggcggcgacggggccgagttcaccagccgccggggcagtagtcgaaggcccggcgcggcatgtcctgggtgccgcggtgcgggcagtgaacgcgcgccgggcgggatgggccggcgccgggcgccagagctgtaccgggctccgttcccgttgtacgcgcttcaggtcgaccccagcactgggctgctcatcgctgcgggcggaggaggcgccgccaagacaggcataaagaatggcgtgcactttctgcagctagagctgattaatgggcgcttgagtgcctccttgctgcactcccatgacacagagacacgggccaccatgaacttggcactggctggtgacatccttgctgcagggcaggatgcccactgtcagctcctgcgcttccaggcacatcaacagcagggcaacaaggcagagaaggccggttccaaggagcaggggcctcgacaaaggaagggagcagccccagcagagaagaaatgtggagcggaaacccagcacgaggggctagaactcagggtagagaatttgcagggcggtgcagacagactttagctccgatccactgcagaaaggtgggtccattttcttgccagtgcagctgtgtctccagctgatccttctgccacacagaggccttaaggtcccggcccacggttaccaacttgccatcaggcctaaagccaggt

SEQ ID NO: 354496 - DNA, 397 bp, Homo sapiens
tgaataaagccatatctaacacctctttccagctggcatgactgaacctgagtgtgaaaagcgtcagcattttaaaaagtcatcactttcttgtcactttctgggctctttccagctatttgggcttcatatgcaattgatttcttctaacggaatagtaaaatataaatgaaaaggttttagaaattactttttatgtatgccaaagcataactacactgcaagtttcaacactgtcatttagaaagccaaatgttctgtgttttattctcttgagagaattctcagtagggtgaataatgtgaacacataaacattaattttagaattttacagtgaaccatgaagcaaaagtgcaatcaaattatacaatttatgaaaaactgagctacttttt

SEQ ID NO: 354497 - DNA, 227 bp, Homo sapiens
ggttacattttcaggaattttgccagtcagtagtttaacaccaccattattaaaaattagattatgtaaatttacagtccaataaagtatatttttaaatattaataaatactcaaaactcctattttactgcattttgttcttatctgtgtttctgagattgtttccatctttgtgtctgtgtggtggaaatgccatataatgtactactgcacatctctttccaa

SEQ ID NO: 354498 - DNA, 303 bp, Homo sapiens
attatatctgcctctggtatgtacctgtaggactgcatgagtgagtatgatcatgtagtaatagaatgaccatctccattggtaaaggcaaaaaacattttgtatcttttatgagtattttaagcttggtgagaaatttacacatttttcttatagatatttgtgtaaagaactcaactgttatcacttgcttttgctattcatactcaagatccacgttaattttgtttaatgatcatgatgttagaagagataatgggtataaagaaaatacttatctaattgagggaaatgcattttttt

SEQ ID NO: 354499 - DNA, 4463 bp, Homo sapiens
  misc_feature (1348)..(1348): n is a, c, g, or t
  misc_feature (1387)..(1387): n is a, c, g, or t
ccgggagagacgtgagggagccgccgctgccacctctcacccctgagtgaagctgggctcgagagggcggccctgtgctccccgggccgactggccagcgggcgcggggcgggggcgggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggangatgactgtcaagttttagaagaggaaagactaatatcncttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttggatttaggaattcaatttttgtttcagtgaccaatgtcaagttgcaggctttgtgtgttgcatatttaatatttctactaccaccgtatgtcaactgggtaaagccttccagagctctctaaatacctgaaagacttaagcctttttttaagtaattaatacttaaaaaaaaagatcctggcatctatttatgcaactaaatacttttcagaaatggtatataaaaggctacagtttaatatctgtatttttataaaagtatgatgaagggtttggggtgtttttatttgtagcagaggtaagaatatgtattcatataatctgcctacttttgagttctcatattaacatttagataacatatgaagtatggcccccttggatccttgtttttaagttactttcgatgtgtatacgaacaaagaccagggagaaacagaacttttaaaactataggctgctgtgttggggccagaaataaggtgacaagtaaagacttttataatacctaccttcaaaattagaatcagcagcactgtacaaataaagtgcctgtgcttcacctcacaccaagaatcttgcctaaccctgtcagagtgcctaatatcctgtggtgattatgtataatgaaacagtcttattttgtgctctttggtttcttaaaaggaaagcttgttttctttcctttatcattacagaggtatgtctttggttcttaaactatctgtctaaaataaagctgtaaaaaattaacagacaaaaaaaaa

SEQ ID NO: 354500 - DNA, 3527 bp, Homo sapiens
  misc_feature (1348)..(1348): n is a, c, g, or t
  misc_feature (1387)..(1387): n is a, c, g, or t
ccgggagagacgtgagggagccgccgctgccacctctcacccctgagtgaagctgggctcgagagggcggccctgtgctccccgggccgactggccagcgggcgcggggcgggggcgggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggangatgactgtcaagttttagaagaggaaagactaatatcncttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttc

SEQ ID NO: 354501 - DNA, 3628 bp, Homo sapiens
  misc_feature (1348)..(1348): n is a, c, g, or t
  misc_feature (1387)..(1387): n is a, c, g, or t
ccgggagagacgtgagggagccgccgctgccacctctcacccctgagtgaagctgggctcgagagggcggccctgtgctccccgggccgactggccagcgggcgcggggcgggggcgggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggangatgactgtcaagttttagaagaggaaagactaatatcncttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaaggtgctgaacatgactgaggccacttaggtcaaaaaacctggactggcttcaaatgtgcatggaaggaattcactgaactttacaaaattcatctcactaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttc

SEQ ID NO: 354502 - DNA, 497 bp, Homo sapiens
gatgagtattatatctgcctctggtatgtacctgtaggactgcatgagtgagtatgatcatgtagtaatagaatgaccatctccattggtaaaggcaaaaaacattttgtatcttttatgagtattttaagcttggtgagaaatttacacatttttcttatagatatttgtgtaaagaactcaactgttatcacttgcttttgctattcatactcaagatccacgttaattttgtttaatgatcatgatgttagaagagataatgggtataaagaaaatacttatctaattgagggaaatgcatttttttaatagatttttatgaaaccagattttgccttggatgattccttaacttttaattcagttttaccatggtctcattttaatactgctggtggaaaaggaaatcgtgatgcagcttcctcaaagttgcttcaagaaaaggtaatttctttttgactttttccatgtaggaaactattctagttaagcgg

SEQ ID NO: 354503 - DNA, 3733 bp, Homo sapiens
  misc_feature (1384)..(1384): n is a, c, g, or t
  misc_feature (1423)..(1423): n is a, c, g, or t
ccgggagagacgtgagggagccgccgctgccacctctcacccctgagtgaagctgggctcgagagggcggccctgtgctccccgggccgactggccagcgggcgcggggcgggggcgggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacaggtgattcacatagtttatatgttgccccatctctagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggangatgactgtcaagttttagaagaggaaagactaatatcncttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttgg

SEQ ID NO: 354504 - DNA, 3031 bp, Homo sapiens
cagctttctagatacataatatgtaaataaagactcaaactagaataaaacacagtttctttgtttttgtaatttttctaaagaggcttgtttttaaataaaaatttaggtacctcagagtttgacagttttaagaatttaataagttataattttataacttaaaaagaaatatgctcttactttacattaaatattatacagtaatatttcctctcgtgattttttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttggatttaggaattcaatttttgtttcagtgaccaatgtcaagttgcaggctttgtgtgttgcatatttaatatttctactaccaccgtatgtcaactgggtaaagccttccagagctctctaaatacctgaaagacttaagcctttttttaagtaattaatacttaaaaaaaaagatcctggcatctatttatgcaactaaatacttttcagaaatggtatataaaaggctacagtttaatatctgtatttttataaaagtatgatgaagggtttggggtgtttttatttgtagcagaggtaagaatatgtattcatataatctgcctacttttgagttctcatattaacatttagataacatatgaagtatggcccccttggatccttgtttttaagttactttcgatgtgtatacgaacaaagaccagggagaaacagaacttttaaaactataggctgctgtgttggggccagaaataaggtgacaagtaaagacttttataatacctaccttcaaaattagaatcagcagcactgtacaaataaagtgcctgtgcttcacctcacaccaagaatcttgcctaaccctgtcagagtgcctaatatcctgtggtgattatgtataatgaaacagtcttattttgtgctctttggtttcttaaaaggaaagcttgttttctttcctttatcattacagaggtatgtctttggttcttaaactatctgtctaaaataaagctgtaaaaaattaacagacaaaaaaaaa

SEQ ID NO: 354505 - DNA, 4564 bp, Homo sapiens
  misc_feature (1348)..(1348): n is a, c, g, or t
  misc_feature (1387)..(1387): n is a, c, g, or t
ccgggagagacgtgagggagccgccgctgccacctctcacccctgagtgaagctgggctcgagagggcggccctgtgctccccgggccgactggccagcgggcgcggggcgggggcgggaacccgggctcgggcccggccgggcgccgggcggcggcggccgtggagcagcagcctcggtgcgacgtggagggctggaggcggcggcgatgcactaggcctcgctcagggcggctgccccgggacccgcagttgagtggtgattttatgcaatggcttcaagccacagttcttcaccagtgcctcaaggaagcagcagtgatgttttctttaaaatagaggtagatccgtcaaaacacattcgacctgtgccatcactgccagatgtgtgtcccaaggaacccacagttacagatcaacatagatggactgtatatcattccaaagtaaatctcccagcagcattaaacgatcctagattagcaaaaagagaatctgacttcttcacaaaaacatggggattggactttgtggacactgaagtcataccttcattctacctcccacagatcagcaaggaacattttacagtatatcaacaggaaatctctcagagagagaagattcatgagagatgcaagaatatttgtcctcctaaagataccttcgaaaggactcttttacatactcatgataaatccaggacagatctggagcaagtacctaagatttttatgaaaccagattttgccttggatgattccttaacttttaattcagttttaccatggtctcattttaatactgctggtggaaaaggaaatcgtgatgcagcttcctcaaagttgcttcaagaaaagctgagccattatctggatattgtggaagtaaacattgctcaccagatctctctacgttcagaagcattttttcatgcaatgacctctcaacacgagttgcaggactacctcaggaaaacttcccaggctgtaaaaatgcttcgagataaaattgcacagattgataaagtaatgtgtgaaggatcactccacattttaagactggcacttaccagaaataattgtgttaaagtatacaataagctgaagttaatggccactgtacaccagactcagcctacagtacaggtgttattatctacttctgaatttgttggagcattggacttaatagcaacaacacaagaggttctacagcaggaacttcagggcattcacagtttccggcatttgggatcacagctttgtgaattagaaaaactgatagataaaatgatgattgcagaattttctacttattctcacagtgacttaaatagaccactggangatgactgtcaagttttagaagaggaaagactaatatcncttgtatttggacttttaaaacaaagaaagcttaattttttagaaatctatggtgaaaaaatggttattacagcaaagaatatcattaaacagtgtgtgattaataaagtttcacaaacagaagaaatagacacagatgttgttgtgaagcttgcagatcagatgagaatgttgaattttccccagtggtttgatctgctcaaggatattttctctaagtttacaattttcctacagagagtgaaggcaacattaaatatcattcacagtgttgttctctcagttcttgacaaaaaccaaaggactagagaattggaagagatttcacaacagaagaatgctgcaaaagataattcactggacacagaggtggcttatttaatccatgaaggcatgtttataagtgatgcattcggtgagggtgagctaacacctatagcagttgacactacctctcaaagaaatgcatctccaaatagtgagccctgcagcagtgattctgtatccgagccagaatgtactactgattcttcatccagcaaagagcacacatcatcatctgctattccaggaggtgtggatattatggtcagtgaagatatgaaattaactgactcagagctaggaaagctggcaaataatatccaggaattattatatagtgcctcagatatatgccatgatcgagctgtcaaatttctcatgtcaagagcaaaggatggttttcttgagaagctaaattccatggaattcataacactttctagattaatggaaacattcattttagacaccgaacagatctgtggaagaaaaagcacgtcattacttggagcacttcagagccaagctattaagtttgtaaataggtttcatgaagagagaaaaaccaagctcagcctcctcttagacaatgagcgctggaagcaagcagatgttcctgcagaatttcaggatcttgttgattctctgtcagatgggaagattgctttacctgaaaaaaaatcaggagccacagaagaaaggaaaccagctgaagttcttattgtcgagggacaacagtatgcagttgttggaaccgtattgctgttaataagaattatccttgaatattgccagtgtgtggataacatcccatctgttactactgacatgcttactcgtctgtcagatttattgaaggtgctgaacatgactgaggccacttaggtcaaaaaacctggactggcttcaaatgtgcatggaaggaattcactgaactttacaaaattcatctcactaagtacttcaattcaagaagttgccagttagttcttggagctggtgcactgcaagttgttggactaaaaacgataactacaaaaaatttggctctttcttcacgatgtttgcagttaattgtgcactacattcctgtgatccgggctcattttgaagctcgactaccacctaagcaatatagcatgcttaggcattttgatcatatcactaaggactaccatgatcacatagctgaaatatcagctaagcttgtagcgataatggatagcttatttgacaagctgttatctaagtatgaagtgaaggctcctgttccttctgcctgtttcaggaatatttgtaagcaaatgacaaaaatgcacgaagctatatttgatctccttccagaagaacaaacacagatgttatttttaagaattaatgcaagttataaactccacttgaaaaagcagttatctcacttaaatgtgataaatgatggaggacctcaaaatgggttggtcacagcagatgtagctttttacactggaaatcttcaagccttaaaaggccttaaagatttggacctaaatatggccgaaatttgggagcagaagaggtgatgtcatcctggaaaactgggtagttcatctgaccatgggatgtgtttgttatgaagaaaatctggatgcctgtgattcgagaattgaacctgaaacccaaagtgaactggggtgggggaagggaaaaaggaaagtatcaagtgttgggaaactggattcagtgggatctacaaggaatgtcatttttgtgcatcctacagtgaggagtaactgatcaggtgtctataacatttttcattctctctggaaacagactcaggtttctttggaccaaatccaaaagaacacatagctgtaacacagctgtagttgactagaatgctctgtatactttatattaaaaaatgctttgcatttcttccagtgcaatgaaattcatatggtgtcccaccttatttaatgatggtacaatttaaaatcttagtcaacttctgtagaaagttttctctatgaaagtaaagctgtttgaaaaattattatttttttacagatctttctataaaaaataaacatcttttgattgcttggatttaggaattcaatttttgtttcagtgaccaatgtcaagttgcaggctttgtgtgttgcatatttaatatttctactaccaccgtatgtcaactgggtaaagccttccagagctctctaaatacctgaaagacttaagcctttttttaagtaattaatacttaaaaaaaaagatcctggcatctatttatgcaactaaatacttttcagaaatggtatataaaaggctacagtttaatatctgtatttttataaaagtatgatgaagggtttggggtgtttttatttgtagcagaggtaagaatatgtattcatataatctgcctacttttgagttctcatattaacatttagataacatatgaagtatggcccccttggatccttgtttttaagttactttcgatgtgtatacgaacaaagaccagggagaaacagaacttttaaaactataggctgctgtgttggggccagaaataaggtgacaagtaaagacttttataatacctaccttcaaaattagaatcagcagcactgtacaaataaagtgcctgtgcttcacctcacaccaagaatcttgcctaaccctgtcagagtgcctaatatcctgtggtgattatgtataatgaaacagtcttattttgtgctctttggtttcttaaaaggaaagcttgttttctttcctttatcattacagaggtatgtctttggttcttaaactatctgtctaaaataaagctgtaaaaaattaacagacaaaaaaaaa

SEQ ID NO: 354506 - DNA, 1328 bp, Homo sapiens
accctgcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtggctgaagccatactattttatagaattaatggaaagcagaaaagacatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaattgatgtt

SEQ ID NO: 354507 - DNA, 650 bp, Homo sapiens
gcacgagaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaattgatgtt

SEQ ID NO: 354508 - DNA, 397 bp, Homo sapiens
gcggccgcgactactactactaaattcgggggtcgaagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaattgatgtt

SEQ ID NO: 354509 - DNA, 1075 bp, Homo sapiens
gcggccgcgactactactactaaattcgggggtcgacataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaattgatgtt

SEQ ID NO: 354510 - DNA, 498 bp, Homo sapiens
gcggccgcgactactactactaaattcgggggtcgactctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaattgatgtt

SEQ ID NO: 354511 - DNA, 370 bp, Homo sapiens
ctgaaacagtcccaacactcagtgagttcaggcagatgagcaaaccaaggcttagagagttcagttgtgtaagactacactgctgggcagtgaatgaacctggaatacaaagactcattcactgtccagcagtagagtttaagtagagtttaaattttattctagcaacatgagagtcacggaaccacatagagatgaggagtctctatcagacgtgtttgcagtgaggtctctctgcacaacagagaaggactcatggaagcaatgggaccaattaagagacattatgttgggaggctgaggtgggtggaacatttgaggtcaggagttcgagaccagcctggccaacatggtgaaaccccatgtctac

SEQ ID NO: 354512 - DNA, 424 bp, Homo sapiens
aaagacaggaagggggaaagactcgattgctttctgattttaatcgggtcaaacagaatgaccaccacaaacgaagagatcttacctctctggagcctcagtctttgtggggaactgtccaggactgaatcctatcagcttgcacttcattctgaatctggctatcaatgactcactcactttgtgtttataactggtcaatactgcctccatgagaagagattcttgcctagaatatatattaataattcagggccaggtccagtggctcaagcctataatcccagcacttttggaggccaaggcaggcagatcgcttgaggccaggagttctagaccagcctggccaacaggagataccctgtctcttctaaaaatacaaaaattagccgagtgtggtgatgcacacctgtagtcccagcta

SEQ ID NO: 354513 - DNA, 376 bp, Homo sapiens
cctgttcctaattaccaggggaaatttcagaagagtgtgatggcctctatgacgcttaattctaacactcaacactcaattcactaattcactggtcagtacagataaataacaaataatttttctttcaacttgatagatatcaaccgtttctattgggttgaatctaccatgatatagtgcagatttgggtctgtaaaatcttgcacgggctccattatcttcctaaactattccaggggtgctgtattccaccggctctgggttagaacgttcccaaccgcagtgatttgtgacttcaaagaacaccctcgagaaggggttccaaaggttttcaggctttaggggagcaacgcggaataaccaaattctgcat

SEQ ID NO: 354514 - DNA, 876 bp, Homo sapiens
  misc_feature (797)..(797): n is a, c, g, or t
  misc_feature (862)..(862): n is a, c, g, or t
  misc_feature (870)..(870): n is a, c, g, or t
aggcccgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaaaggntaatctggactggctttgccaggggggaaaacctttcccaaatttaaccttggcccattgggaanaagaaaanccccgt

SEQ ID NO: 354515 - DNA, 1263 bp, Homo sapiens
tgagggtctgagatttcattctttgtagaagctcacgagaaatcctgtggccattccacctaggaggggacggcaggcagaatactcactgtggttgtcagggccctatcagttccttttgcccaccattcccatgacgcagaggcccagcaggtgcaggcacagctgagaaactcggaggtgaggagtgagcctgctctgttgggagctggggggccattacctcacccctcagttttttttttgctgctgacacaaccttgagaagtggcccaggtggagcacggtggggttcttggcacatgcaggaacatggagggaggcgtggctgatggcaggtggcttgctcaaggcctgatgcttttttgctgaaattgaattttcacgtgaatctgctgctcaaccctaatctaacaggctgggaccttgtccatttgattttctcacacagcatctaattaaggctgatattcacaggcatgaggccaactgtaagacctcaaccctgtctccacagtccttgtcattcagggggaacctggaactcctgactggtgacctcccacctgcctcttcaggggctcctcccggtgtacaagggtgatggtgctctccacagccatggagtcagtgcatccactgtaactgcctcttctccagccatgccctactcacaccggaacttctgtgcacgtggagtatgtgtgcagtgtccctgccttgcgtcacgtggctgctgagaagggtcttggcaggtaatgtgcttagccaggtggtcaccttcaggtctagcacaggggttgctgttgctttttctctacttcaggctttctgggccgcccaaccatgggacaagagccaaggcacccacatgcaccgcctgcaactcctgttcctggccttccaaaacactgctcacaaagactgaccctgcctcctcctgggctctcgtcatctcctcttggccacttcctggttcatgatcaggacagaaggaggggaacgtcagccatatggatggtctgaaaattccagattctgtgctaaccataatgctgtgttcttttcactaacagcaaccagccaaaaaggggctggggtgcaagcttcattctgcttcagcacctggattctctctggattgacatggtcctaagtcaggggctggcaaaccattcgtagctttttacatttctgaatggttggggagaaaataagagacttgtgacatttgaaaactatgttaaaatcgaatttgactgt

SEQ ID NO: 354516 - DNA, 3701 bp, Homo sapiens
aggcccgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcgcctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggctcacactggcttcaacaatacggaaatgcattagctcatgttggaggaggtccaggagtgcctagaattccaacttcaaattaggtccttgtcttagaacttaacccagccacccaggaccagagggcccagccctatccccttcctcagagaggcaggctgggctagcaggtacacgccatcattactggtgtggttggcatttatggagcacataccagtgccaggcacagaagcaaggtgtcacagcaaggttctgaggtcacacttgtgtcccaggggcttgctgtgtgacctaggacatcattgccctccctgaaactcagagccttatttgtgtatctgaaaacatgcactgtgagagggtactgagaggaaacaatgtagagaaacatgccttactgggcctgtcagagaacgagcactcaagcaaataccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgaagaccatcctggctaacacagtgaaaccccgtgtctactaaagatacaaaaaattagccgggcgtggtggcgggcacctgtagtctcagctacttgggaggctaggcaggaaaatggtgtgaacctggggggcggagcttgcagtgagccaagatcacgccactgcactccagcctgggtgacaagagtgtgactctgtatcaaaag

SEQ ID NO: 354517 - DNA, 4088 bp, Homo sapiens
aggcccgtttccggcggcgtcgcgcgtttgcgagcctcgggtggtcctcagggagggtctctcggccagaacacgtggatgcccacccaccactgagcctcatggtaggaagcttgactgcctccttcccctcgcatgtcctgtgaaggcccacctcctgctctgcccactggccctgggcccagaccctaccttggcccttgctgggcttaggaaggcccccttgcccccaaccccaaggtagtgagcaaacccctgcccaaaccagggcctaattgaggctcttgaggggggagggttgtatgaccaccatggactgggttccttcctcctccccgagactgcccctccccagaatattagaggcagaggagtcctggtgagcgtctcgcccaaccccatggggcagctgcctgagacatgtcatgaggcagcgccagaagggggctggcacccagggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcgcctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggctcacactggcttcaacaatacggaaatgcattagctcatgttggaggaggtccaggagtgcctagaattccaacttcaaattaggtccttgtcttagaacttaacccagccacccaggaccagagggcccagccctatccccttcctcagagaggcaggctgggctagcaggtacacgccatcattactggtgtggttggcatttatggagcacataccagtgccaggcacagaagcaaggtgtcacagcaaggttctgaggtcacacttgtgtcccaggggcttgctgtgtgacctaggacatcattgccctccctgaaactcagagccttatttgtgtatctgaaaacatgcactgtgagagggtactgagaggaaacaatgtagagaaacatgccttactgggcctgtcagagaacgagcactcaagcaaataccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgaagaccatcctggctaacacagtgaaaccccgtgtctactaaagatacaaaaaattagccgggcgtggtggcgggcacctgtagtctcagctacttgggaggctaggcaggaaaatggtgtgaacctggggggcggagcttgcagtgagccaagatcacgccactgcactccagcctgggtgacaagagtgtgactctgtatcaaaag

SEQ ID NO: 354518 - DNA, 3237 bp, Homo sapiens
aggcccgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcgcctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggctcacactggcttcaacaatacggaaatgcattagctcatgttggaggaggtccaggagtgcctagaattccaacttcaaattaggtccttgtcttagaacttaacccagccacccaggaccagagggcccagccctatccccttcctcagagaggcaggctgggctagcaggtacacgccatcattactggtgtggttggcatttatggagcacataccagtgccaggcacagaagcaaggtgtcacagcaaggttctgaggtcacacttgtgtcccaggggcttgctgtgtgacctaggacatcattgccctccctgaaactcagagccttatttgtgtatctgaaaacatgcactgtgagagggtactgagaggaaacaatgtagagaaacatgccttactgggcctgtcagagaacgagcactcaagcaaataccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgaagaccatcctggctaacacagtgaaaccccgtgtctactaaagatacaaaaaattagccgggcgtggtggcgggcacctgtagtctcagctacttgggaggctaggcaggaaaatggtgtgaacctggggggcggagcttgcagtgagccaagatcacgccactgcactccagcctgggtgacaagagtgtgactctgtatcaaaag

SEQ ID NO: 354519 - DNA, 1172 bp, Homo sapiens
aggcccgtttccggcggcgtcgcgcgtttgcgagcctcgggtggtcctcagggagggtctctcggccagaacacgtggatgcccacccaccactgagcctcatggtaggaagcttgactgcctccttcccctcgcatgtcctgtgaaggcccacctcctgctctgcccactggccctgggcccagaccctaccttggcccttgctgggcttaggaaggcccccttgcccccaaccccaaggtagtgagcaaacccctgcccaaaccagggcctaattgaggctcttgaggggggagggttgtatgaccaccatggactgggttccttcctcctccccgagactgcccctccccagaatattagaggcagaggagtcctggtgagcgtctcgcccaaccccatggggcagctgcctgagacatgtcatgaggcagcgccagaagggggctggcacccagggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacaggctttctgggccgcccaaccatgggacaagagccaaggcacccacatgcaccgcctgcaactcctgttcctggccttccaaaacactgctcacaaagactgaccctgcctcctcctgggctctcgtcatctcctcttggccacttcctggttcatgatcaggacagaaggaggggaacgtcagccatatggatggtctgaaaattccagattctgtgctaaccataatgctgtgttcttttcactaacagcaaccagccaaaaaggggctggggtgcaagcttcattctgcttcagcacctggattctctctggattgacatggtcctaagtcaggggctggcaaaccattcgtagctttttacatttctgaatggttggggagaaaataagagacttgtgacatttgaaaactatgttaaaatcgaatttgactgt

SEQ ID NO: 354520 - DNA, 1094 bp, Homo sapiens
aggcccgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagtccttgtcattcagggggaacctggaactcctgactggtgacctcccacctgcctcttcaggggctcctcccggtgtacaagggtgatggtgctctccacagccatggagtcagtgcatccactgtaactgcctcttctccagccatgccctactcacaccggaacttctgtgcacgtggagtatgtgtgcagtgtccctgccttgcgtcacgtggctgctgagaagggtcttggcaggtaatgtgcttagccaggtggtcaccttcaggtctagcacaggggttgctgttgctttttctctacttcaggctttctgggccgcccaaccatgggacaagagccaaggcacccacatgcaccgcctgcaactcctgttcctggccttccaaaacactgctcacaaagactgaccctgcctcctcctgggctctcgtcatctcctcttggccacttcctggttcatgatcaggacagaaggaggggaacgtcagccatatggatggtctgaaaattccagattctgtgctaaccataatgctgtgttcttttcactaacagcaaccagccaaaaaggggctggggtgcaagcttcattctgcttcagcacctggattctctctggattgacatggtcctaagtcaggggctggcaaaccattcgtagctttttacatttctgaatggttggggagaaaataagagacttgtgacatttgaaaactatgttaaaatcgaatttgactgt

SEQ ID NO: 354521 - DNA, 2352 bp, Homo sapiens
gcgcggcggcggacctcgggttgccctcggtccgagtgatccctggtcgcttccttagccctcccgccttcggcattggggtccccgcgtcccccgggcctccaggcgggaaagcgcgggggctttgcggggccttgagcgcctggtgtgggaggtggtcgagcccagccaccctcccccgcggcggcgcgaggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctacagccttaactta

SEQ ID NO: 354522 - DNA, 1439 bp, Homo sapiens
cgagctcggtacccccctgttggcatcactgggattccgagaggaaagaggagagccccactgcttcctgtttgcctcctccaccatccctgacctccgttgagctgcctctggccctgttgctgctgccacatcctaggtctaagagttggacgcctttcctaggcccctaccaactgagcccctcacgccgggctggctgccacccaggcttccccgcctcataggtaaccctggtgagggctattttcttcacagggggtctttgggagaatggtgactcccttgaccccgcttttcatttaaggataacaccctggaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggctcacactggcttcaacaatacggaaatgcattagctcatgttggaggaggtccaggagtgcctagaattccaacttcaaattaggtccttgtcttagaacttaacccagccacccaggaccagagggcccagccctatccccttcctcagagaggcaggctgggctagcaggtacacgccatcattactggtgtggttggcatttatggagcacataccagtgccaggcacagaagcaaggtgtcacagcaaggttctgaggtcacacttgtgtcccaggggcttgctgtgtgacctaggacatcattgccctccctgaaactcagagccttatttgtgtatctgaaaacatgcactgtgagagggtactgagaggaaacaatgtagagaaacatgccttactgggcctgtcagagaacgagcactcaagcaaataccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgaagaccatcctggctaacacagtgaaaccccgtgtctactaaagatacaaaaaattagccgggcgtggtggcgggcacctgtagtctcagctacttgggaggctaggcaggaaaatggtgtgaacctggggggcggagcttgcagtgagccaagatcacgccactgcactccagcctgggtgacaagagtgtgactctgtatcaaaag

SEQ ID NO: 354523 - DNA, 3624 bp, Homo sapiens
aggcccgtttccggcggcgtcgcgcgtttgcgagcctcgggtggtcctcagggagggtctctcggccagaacacgtggatgcccacccaccactgagcctcatggtaggaagcttgactgcctccttcccctcgcatgtcctgtgaaggcccacctcctgctctgcccactggccctgggcccagaccctaccttggcccttgctgggcttaggaaggcccccttgcccccaaccccaaggtagtgagcaaacccctgcccaaaccagggcctaattgaggctcttgaggggggagggttgtatgaccaccatggactgggttccttcctcctccccgagactgcccctccccagaatattagaggcagaggagtcctggtgagcgtctcgcccaaccccatggggcagctgcctgagacatgtcatgaggcagcgccagaagggggctggcacccagggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcgcctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggctcacactggcttcaacaatacggaaatgcattagctcatgttggaggaggtccaggagtgcctagaattccaacttcaaattaggtccttgtcttagaacttaacccagccacccaggaccagagggcccagccctatccccttcctcagagaggcaggctgggctagcaggtacacgccatcattactggtgtggttggcatttatggagcacataccagtgccaggcacagaagcaaggtgtcacagcaaggttctgaggtcacacttgtgtcccaggggcttgctgtgtgacctaggacatcattgccctccctgaaactcagagccttatttgtgtatctgaaaacatgcactgtgagagggtactgagaggaaacaatgtagagaaacatgccttactgggcctgtcagagaacgagcactcaagcaaataccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgaagaccatcctggctaacacagtgaaaccccgtgtctactaaagatacaaaaaattagccgggcgtggtggcgggcacctgtagtctcagctacttgggaggctaggcaggaaaatggtgtgaacctggggggcggagcttgcagtgagccaagatcacgccactgcactccagcctgggtgacaagagtgtgactctgtatcaaaag

SEQ ID NO: 354524 - DNA, 3526 bp, Homo sapiens
aggcccgtttccggcggcgtcgcgcgtttgcgagcctcgggtggtcctcagggaggcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctacagccttaacttacttattttatatggaatcgtttatactgacaaacatgtagaatgttggtaaaggttcagaattgctctcaagaatatccaacttcaggccgagtgtggtggctcatgcctgtcatcccagcactttgggaggccaaggcgggcacatcacgaggtcaggaggttgagaccatcctgggtaacaggtgaaaccccatctctactaaaaatacaaaaatttagctgggcgtggtggcaggcgcctgtggtcccagctgctcgggaggctgaggcaggagaatggcatcagcccaggaggcggagcttgcagtgagctgagatcgcgccactgcactccagcctgggtgacagagtgagactccctctcaaaaaaaaaaaaaaaaaaaaaatccaacttcatacaaaatgtatgtttatttcctgaaatgtttgaccttaacctgttcaataaagcctgtgtccctcaaaatcagggtgcagtctgcagttttgagttgacaggtccctgtgaatgaggaagcagcacaaggagggctctacgagcgctgctagactgagtaggttaaaataatttacctaaactcttttcccttaagtatcagtggctcacactggcttcaacaatacggaaatgcattagctcatgttggaggaggtccaggagtgcctagaattccaacttcaaattaggtccttgtcttagaacttaacccagccacccaggaccagagggcccagccctatccccttcctcagagaggcaggctgggctagcaggtacacgccatcattactggtgtggttggcatttatggagcacataccagtgccaggcacagaagcaaggtgtcacagcaaggttctgaggtcacacttgtgtcccaggggcttgctgtgtgacctaggacatcattgccctccctgaaactcagagccttatttgtgtatctgaaaacatgcactgtgagagggtactgagaggaaacaatgtagagaaacatgccttactgggcctgtcagagaacgagcactcaagcaaataccaacccccccatccatgccagcatctccagcacacccgtgtgcgcacaggccctgaggctgatgactgtcttgtactggcctagttgccccacttttttttggtaggggggaacgcggtgaggaggaaataaagacagtggagaaaaagacgaaaatgggccgggcgtggtggctcacgcctgtaatcccagcactttgggaggtcgaggtgggtggatcatgaggtcaggagatgaagaccatcctggctaacacagtgaaaccccgtgtctactaaagatacaaaaaattagccgggcgtggtggcgggcacctgtagtctcagctacttgggaggctaggcaggaaaatggtgtgaacctggggggcggagcttgcagtgagccaagatcacgccactgcactccagcctgggtgacaagagtgtgactctgtatcaaaag

SEQ ID NO: 354525 - DNA, 1047 bp, Homo sapiens
aggcccgtttccggcggcgtcgcgcgtttgcgagcctcgggtggtcctcagggagggtctctcggccagaacacgtggatgcccacccaccactgagcctcatggtaggaagcttgactgcctccttcccctcgcatgtcctgtgaaggcccacctcctgctctgcccactggccctgggcccagaccctaccttggcccttgctgggcttaggaaggcccccttgcccccaaccccaaggtagtgagcaaacccctgcccaaaccagggcctaattgaggctcttgaggggggagggttgtatgaccaccatggactgggttccttcctcctccccgagactgcccctccccagaatattagaggcagaggagtcctggtgagcgtctcgcccaaccccatggggcagctgcctgagacatgtcatgaggcagcgccagaagggggctggcacccagggattcctggggtgctggtgtgtgtcctttcaggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccccctattaacctactgggagaactctctgtgctagtaaccccgttctcctgata

SEQ ID NO: 354526 - DNA, 1980 bp, Homo sapiens
  misc_feature (123)..(123): n is a, c, g, or t
gctactcaggaggctgaggcaggataattgcttgaacccgggaggtggaggttgcagtgagccgagatcatgccactgcactccagcctgggcaacagagtgagactttgtctcaaaaaaaanaaaaaaaaaaaaaaagatctggcggatgaaaataaccagaatgaaaatagctagaaaactcagcaagcaggaagctccctttctcacccttttgttcccttgccgatagaatcagtcactattagaaaaaatgaaagacgctctgtttaaaacaatgatgacagcagtacttaatatgtatttcgaggtgaacttatatagattgagagaggctgcatttggcagactgatgtataggaagacccatttgtttctagcttctccctgcagggaaaatgctttcgtcattatagcctctttacacagactggccattctagtgaaacaggtggtaaacctttgggctgcccagaaacattttatctgttttcacttacctaggaaggggaaagattagcgggtcatccaaaatctgtatgtaagctatcttcattttcttccccaaccttctcctcctgggaaacacaaatgctatctcatctgacaaaaggttttagaggataaagctgaaaagattggattgggatctttttgtggcttggggcggagccttttgctaaaatctcaagaatgctgctttgagtttagctagggtggctctcagaactggggtgcctggcattctcagcatttctcaggggcctcccacctctgacaactgcagtgttagctaatacataccttgagcatagaactgaatgctgtaattcagagccattttttttttcaacttgaacattgtacaattttactgcaatttcctttgaactttcttgccactgtttggaatcttaaaaattcattagccttctcctttctgacataaagctactcttcatcagagatgagttcctatgtatgtcctttgttccttcaatagctaattaatgtgcttgaggatacttcagtggaaaaaaaggtttaaatatgcaaattactaataaatgtgtaaccttatgtaacttgtgttacatcaagtaacaagctaatctagtttgtttcactggactaggcttgtgctccctacttcagtattttgatgctttccttgatctttgtttcacaaaatgttgtgaattttggtatcattcaaaacaaatgacatttattaggtttcattttgaaacgatgtacagacaagtccccaacttagaaaccggtttgttcttaaggttcttgcgtcagcccatagaagcccactgacctccaccacagcccaaatggagggctgtgatagccagatctggttggcttttgtgggctgacccagacatttaatcaccatctcttatgttgttgccgtaagaaatgcattccaggttgggacttgggatcctgagagcacattcgccccctgtggtggccgcttgccaccttgcaagatggaagcccagtctccttactaccaaactgtagttgtaagcagagggaggggtgagatgtttataggacattccctaagctggggagtgatttttatcactattcatgtcaactgtactttggtatagactccctatcaatttaataatatgaaaagcctaaaataaaactatgcatgctattctatgtgctattttatatcagtaaataagcttatgcttgccagttgtatacacagttatgaggtgtatagaactgactttgacagtattttttgcactgtttcctatctgtttttataaagtcttatttagatattggaccttgttgatgttctcactgcccttgtgcttgctataaaatgtttcatatgtgcctttacaaatgtgagatctttattctaacctttttttgtaaaagatatctattgatttccatatgcaataaacctttttttcagagaaaaaaaaaatc

SEQ ID NO: 354527 - DNA, 672 bp, Homo sapiens
tactactactaaattcgcggccgcgtcgaccccaaatggagggctgtgatagccagatctggttggcttttgtgggctgacccagacatttaatcaccatctcttatgttgttgccgtaagaaatgcattccaggttgggacttgggatcctgagagcacattcgccccctgtggtggccgcttgccaccttgcaagatggaagcccagtctccttactaccaaactgtagttgtaagcagagggaggggtgagatgtttataggacattccctaagctggggagtgatttttatcactattcatgtcaactgtactttggtatagactccctatcaatttaataatatgaaaagcctaaaataaaactatgcatgctattctatgtgctattttatatcagtaaataagcttatgcttgccagttgtatacacagttatgaggtgtatagaactgactttgacagtattttttgcactgtttcctatctgtttttataaagtcttatttagatattggaccttgttgatgttctcactgcccttgtgcttgctataaaatgtttcatatgtgcctttacaaatgtgagatctttattctaacctttttttgtaaaagatatctattgatttccatatgcaataaacctttttttcagagaaaaaaaaaatc

SEQ ID NO: 354528 - DNA, 466 bp, Homo sapiens
ggataatgaagtccctctcctctataacctatggctaactgctcaccaaaaatgtctgacattattaagcatttagctgggaaacatcagtgttaacagattgtccttgtatcttttttagtttttaaaattcattttgtccttgtatcttttttaatttttaaaattcatttattttttcttttttcagcaagtccttatatcatcaatgtccttatatcttaaaaaagtgatatggaaaaaaactggttaagtaaatatttctatatgtatatattgttttcttaaaataaataaaaaatggtccaggacattctttccatcctatcacacttttattttcattcaaacagctgaaattcatttttttcctgtttgtgctttgtgccacaataataatgttggatggaattctgtcatgtatcccgtaattcaatggataaaacatcaggaacacattaacaaa

SEQ ID NO: 354529 - DNA, 2459 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctctctactttttcttcttcttgctggtgatggtcttgctggatggggacacggtcacatcctccttgggagggtccagtatgaggtgagaggatgacacgtctgccggctcctttagcactgtgatgtccacctcataagtcatgtctcttgggcctcttcctctctcaagatgaagatgttcagccttgcttccag

SEQ ID NO: 354530 - DNA, 501 bp, Homo sapiens
ggcagtatttgcacaatgatgagatcattcctgttcttcttcttattttaaataatagagacgtctcactgtgttgccatgctggtcttgaactcctgagctcaagtgatcctcccgcctcagcctctgaaaatactaggattacaattcctgtttttctaaaaccggtttttgttttgttttgtcattagcatgtgtgacacaagaggtcgacattgaacttagcgttttcaatagctaagatgaaatgtttctattcatgttgtgcttctgtttcctcatgtttcaggaggaaaataagattttattttatcatccaaatgaggtagaaaagaatgagaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtt

SEQ ID NO: 354531 - DNA, 1865 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtt

SEQ ID NO: 354532 - DNA, 2022 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagttaaaaaaaagaatgccaaaaataaaaaaaaaaaataaagaataaaaacaaaaagagattaacactagacaccaaacaatatccccaaaaaagatctgcaccactgaaaataaaaccctcttgggggggccctctgcacaaaatgcctttatatggtgc

SEQ ID NO: 354533 - DNA, 2049 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccaggtgattccagccacttctccaatcaggcgtcccctttctaagacgagaaaagacacagaaaatcccttcaagccctttccatggggttcaagcgtgaaccaccttcatgggcgccgcttccaaacagacccgggagccctgaagtcaccggttccctcgcgcggcactccctgagccttttaaatgccacgtgcgcccgttccatttcctgttcttggtttggaacgcttattctcacagtctggccgtatgagtaacgaacgattgcattttgaccctcgtcttgcagagtggatgaagatgaggagatcattgtgaaggccatgagtgattactgggttgttggaaagaagtctgatcggcgggagctctatgttattttgaatcaaaaaaatgcaaacctgattgaagtaaatggtaagtaggatttggtatttcaggagaatttgagaagttgtcttttcattgcattaagaaacatggttaaaaaataggtaaatagaacaaatcatgactgttgagattctaagcaggtgcctctgctccacatttgatccattttctgttccttggaaaactatgacaagaccttcctgtagcacaggaaacttggcaatggccgaaagaaaattattttctacaattcta

SEQ ID NO: 354534 - DNA, 1340 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggtaggtacaccccgaggcatggtattaaaagaagaaattaagataataaaaacagcagtgactggattgatgacaggttgtcaaacaggaacttgcagcggggaggatgggtaggaagcatcttcatagatattgtcaaaataaagcagtgattatttaaagcagaactagggtgatttgggttcaaatttccaagcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtt

SEQ ID NO: 354535 - DNA, 1095 bp, Homo sapiens
ggcagtatttgcacaatgatgagatcattcctgttcttcttcttattttaaataatagagacgtctcactgtgttgccatgctggtcttgaactcctgagctcaagtgatcctcccgcctcagcctctgaaaatactaggattacaattcctgtttttctaaaaccggtttttgttttgttttgtcattagcatgtgtgacacaagaggtcgacattgaacttagcgttttcaatagctaagatgaaatgtttctattcatgttgtgcttctgtttcctcatgtttcaggaggaaaataagattttattttatcatccaaatgaggtagaaaagaatgagaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctctctactttttcttcttcttgctggtgatggtcttgctggatggggacacggtcacatcctccttgggagggtccagtatgaggtgagaggatgacacgtctgccggctcctttagcactgtgatgtccacctcataagtcatgtctcttgggcctcttcctctctcaagatgaagatgttcagccttgcttccag

SEQ ID NO: 354536 - DNA, 2748 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtctgagaaagaaccccagtttaagtttatctacttcaaccacatgaatctcgccgagaagagcacagttcacatgaggaaaacgcccagcgtgtcgctcacttccgtgcacccggatttaatgaagattctcggtgacatcaacagtgactttaccaggtgattccagccacttctccaatcaggcgtcccctttctaagacgagaaaagacacagaaaatcccttcaagccctttccatggggttcaagcgtgaaccaccttcatgggcgccgcttccaaacagacccgggagccctgaagtcaccggttccctcgcgcggcactccctgagccttttaaatgccacgtgcgcccgttccatttcctgttcttggtttggaacgcttattctcacagtctggccgtatgagtaacgaacgattgcattttgaccctcgtcttgcagagtggatgaagatgaggagatcattgtgaaggccatgagtgattactgggttgttggaaagaagtctgatcggcgggagctctatgttattttgaatcaaaaaaatgcaaacctgattgaagtaaatgaagaggtcaagaaactttgtgcaacgcagttcaacaacatcttcttcttggattgacggatgacggctcaccgagagcatatctaaaaaacactctgcaaacatttggtcacatgcaagttagtggtcatatgacggactgcattcaggacaagggtaaagcaatacttgctttgaagaatcacatttcgactcggtctgctgatctgaggtttttagattttaaatatttatgtggaattaattaaaggtagttggctatatcgctatcatttcattcttttgacattatgtgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctctctactttttcttcttcttgctggtgatggtcttgctggatggggacacggtcacatcctccttgggagggtccagtatgaggtgagaggatgacacgtctgccggctcctttagcactgtgatgtccacctcataagtcatgtctcttgggcctcttcctctctcaagatgaagatgttcagccttgcttccag

SEQ ID NO: 354537 - DNA, 1403 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggccctgggcggcccaggagaagcagttcccgccggcgctgctgagtttcttcatctacaacccgcgcttcgggccgcgcgaaggacaggaggaaaataagattttattttatcatccaaatgaggtagaaaagaatgagaagattagaaatgtcggattgtgtgaagctattgtacagtttacaaggacatttagcccatcaaaacctgcaaaatctttacatacacagaagaacagacagttcttcaatgaaccagaagaaaatttctggatggtcatggttgttcggaatcctataattgaaaaacagagtaaagatggaaaaccagttattgaatatcaagaggaggagttgttggacaaggtttatagctcggtgctgcggcagtgctacagcatgtacaagctttttaatggtacatttctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatagaatggaggaaagcctgaatatagtcaaatacactgcttttctctataacgatcagctcatctggagtggattagaacaagatgacatgagaattttatacaaataccttaccacctccctttttccaaggcacatcgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttgggccccagctcacagtgctggcctctgacatctgtgaacagtttaacatcaacaagaggatgtccgggtttgtactttgctttcggttcactttcaggcattgaacggcttttgaaatacacgtagttttcacttacaaatacgggtggtattaacagtcctgtgttctcgtggactgtagaggatggtgctacgtgccattcaggcctctgtctgaaagggtcccgg

SEQ ID NO: 354538 - DNA, 2197 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaagagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354539 - DNA, 738 bp, Homo sapiens
cagaaagctgaggcaggagaatcgcttgaacccaggatgcagaggttgcagtgagctgagctcgcgccattgcactccagcctggaacagagcaagactgtctcaaaaaaaaaaaaaagggcagcaaggggactttgccctgggagactggccctgaaccatacacatcatacttttttctgtgacagtcaggggtttcaaaatgcctgtttacatcctgggacagctttagaccatggcataagagaagacccatgtgcatgacgcccctggctctgcaggtagattggccactgctgtttctggcagtctgaattcccctaccccaagctgtataagggagcgagccttgtgctgcatggaatcatcatcaccgtgaccctccctttccaccctgaactcatcagtctctctctgtttcaggataggatttttgggccttggtctcatgggaagtggaatcgtctccaacttgctaaaaatgggtcacacagtgactgtctggaaccgcactgcagagaaagtaagcattcaggggtggtgcctgttggatcggtggagtctggggtaaccctaagagtggacatctccccctgttgtctcagcgttctgcgtgcaatagaatagaagccaagcttttagtccaggcaggtagagatgtagatgcctaaacttaggatgttattataaaacctaaacatttgcctggcgcggtggctcactcctgtaatcccagca

SEQ ID NO: 354540 - DNA, 690 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccaggtgagagacacaatgttcactttctaccaatgccagactggtgatttttgcatagcaactaacagattaaatgtcacccaaacgcaaacctttgttcttctgaaatgctactggagaaagctacttcagttctaaggtgtcagcgttttgcttatcagtttgaaactccatgcagctaacctttctggagtaggttgttgcttttaggaaaattgcttggacccaggagaaatatctcagcatttgagtctagcacaggccatttcttcctttcatagcacacagattaggagcatagcctctgaaatacatatactgc

SEQ ID NO: 354541 - DNA, 2332 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctgatagaaatcaggaaatgagccaaaacagcagcaggattctgatctgaggtctgtagggctcctgagcatctgcccgggagcctgggctattgcttctcccttgtgtccccacagctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354542 - DNA, 2164 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354543 - DNA, 2146 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaagagggggcccgtctgggaagaacccccgctgaagtcgtctcaacctgcgacatcactttcgcctgcgtgtcggatcccaaggcggccaaggacctgatagaaatcaggaaatgagccaaaacagcagcaggattctgatctgaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354544 - DNA, 1755 bp, Homo sapiens
cagaaagctgaggcaggagaatcgcttgaacccaggatgcagaggttgcagtgagctgagctcgcgccattgcactccagcctggaacagagcaagactgtctcaaaaaaaaaaaaaagggcagcaaggggactttgccctgggagactggccctgaaccatacacatcatacttttttctgtgacagtcaggggtttcaaaatgcctgtttacatcctgggacagctttagaccatggcataagagaagacccatgtgcatgacgcccctggctctgcaggtagattggccactgctgtttctggcagtctgaattcccctaccccaagctgtataagggagcgagccttgtgctgcatggaatcatcatcaccgtgaccctccctttccaccctgaactcatcagtctctctctgtttcaggataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354545 - DNA, 2071 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaagagggggcccgtctgggaagaacccccgctgaagtcgtctcaacctgcgacatcactttcgcctgcgtgtcggatcccaaggcggccaaggacctgatagaaatcaggaaatgagccaaaacagcagcaggattctgatctgaggtctgtagggctcctgagcatctgcccgggagcctgggctattgcttctcccttgtgtccccacagctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354546 - DNA, 536 bp, Homo sapiens
tggtgatcttagcggctggagacaggggcttatatgaggactgcagcagctgcttccaggcgatggggaagacctccttcttcctaggtaacacgcctgcacctgtcaggcctggagcctggggccacatctcctctgtttcacactgatgacagcgtcagtcccacacggcctttctgccggggaccctggggaaggtttcctttcacctgcatagtcagtgcgtggaaggaggaagagccagtctgtcgggggcaggtgaagggggcctcccctggagagaggtgggtctgagcagaggtgagggtggacagagaagccctgtctgtggcattcttgggctgtgaccgtgagtctttaccctgggcaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctgga

SEQ ID NO: 354547 - DNA, 832 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagcatctgggaacaaagtcagtcgccagtcagtgttgtgtggaagccagaacatcgttctcaatggcaagaccattgtgatgaatgactgtattatccgaggggatctggcaaatgtaagagttggacgtcattgtgttgtgaaaagtcgtagtgtcataaggccaccattcaagaagttcagcaaaggtgttgcattctttcctttacatattggagaccatgtctttattgaggaacgatcgtgtggctcaccgcaggcacagattggttcctatgttcatgttgggaagaactgtgtgatcgggcgcgcatgtgtg

SEQ ID NO: 354548 - DNA, 2215 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354549 - DNA, 2164 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctgatagaaatcaggaaatgagccaaaacagcagcaggattctgatctgaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354550 - DNA, 2011 bp, Homo sapiens
taaatctgcttctcccaatgtctgggacgacagcagaatctatttctagggtcattgtgaggagaccacacagagtgcctgtagcagcacatggcacctgtaaatgatggtggcgatggcggcagcagctgtggtggtagttatcattattattattaaactttcagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaatgtgatttgttcatccaggagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354551 - DNA, 1737 bp, Homo sapiens
cagaaagctgaggcaggagaatcgcttgaacccaggatgcagaggttgcagtgagctgagctcgcgccattgcactccagcctggaacagagcaagactgtctcaaaaaaaaaaaaaagggcagcaaggggactttgccctgggagactggccctgaaccatacacatcatacttttttctgtgacagtcaggggtttcaaaatgcctgtttacatcctgggacagctttagaccatggcataagagaagacccatgtgcatgacgcccctggctctgcaggtagattggccactgctgtttctggcagtctgaattcccctaccccaagctgtataagggagcgagccttgtgctgcatggaatcatcatcaccgtgaccctccctttccaccctgaactcatcagtctctctctgtttcaggataggatttttgggccttggtctcatgggaagtggaatcgtctccaacttgctaaaaatgggtcacacagtgactgtctggaaccgcactgcagagaaagagggggcccgtctgggaagaacccccgctgaagtcgtctcaacctgcgacatcactttcgcctgcgtgtcggatcccaaggcggccaaggacctggtgctgggccccagtggtgtgctgcaagggatccgccctgggaagtgctacgtggacatgtcaacagtggacgctgacaccgtcactgagctggcccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtgaagtgggcaatgcagccaagatgatgctgatcgtgaacatggtccaagggagcttcatggccactattgccgaggggctgaccctggcccaggtgacaggccagtcccagcagacactcttggacatcctcaatcagggacagttggccagcatcttcctggaccagaagtgccaaaatatcctgcaaggaaactttaagcctgatttctacctgaaatacattcagaaggatctccgcttagccattgcgctgggtgatgcggtcaaccatccgactcccatggcagctgcagcaaatgaggtgtacaaaagagccaaggcgctggaccagtccgacaacgatatgtccgccgtgtaccgagcctacatacactaagctgtcgacaccccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactg

SEQ ID NO: 354552 - DNA, 1198 bp, Homo sapiens
ggcccactccaatgggcggcgccggggcgacttgctgttcccggcggcccgtgcgtcggcggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcatgcctggatcaaagtggaacagctgaagccatatcatgctcataaagaggaaatgataaaaattaacaagggtaaacgattccagcaagcggtagatgctgtcgaagagttcctcaggagagccaaagggaaagaccagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggatctcaccatcccggagtctagtaccgtgaaggggatgatggccggaccgatggccgcgtttaaatggcagccaaccgcaagcgagcctgttaaagatgcagatcctcatttccatcatttcctgctaagccaaacagagaagccagctgtctgttaccaggcaatcacgaagaagttgaaaatatgtgaagaggaaactggctccacctccatccaggcagctgacagcacagccgtgaatggcagcatcacacccacagacaaaaagataggatttttgggccttggtctcatgggaagtggaatcgtctccaacttgctaaaaatgggtcacacagtgactgtctggaaccgcactgcagagaaagtaagcattcaggggtggtgcctgttggatcggtggagtctggggtaaccctaagagtggacatctccccctgttgtctcagcgttctgcgtgcaatagaatagaagccaagcttttagtccaggcaggtagagatgtagatgcctaaacttaggatgttattataaaacctaaacatttgcctggcgcggtggctcactcctgtaatcccagca

SEQ ID NO: 354553 - DNA, 751 bp, Homo sapiens
actcactttctgacttaggccacaggtcgttttaccatgtctggacgtggcaagcagggcggcaaggctcgcgccaaggccaaaacccgctcctctagagctgggctccaatttcctgtaggacgagtgcaccgcctgctccgcaagggcaactacgctgagcgggtcggggccggcgcgccggtttacctggcggcggtgctggagtacctaactgccgagatcctggagctggcgggcaacgcagcccgcgacaacaaaaagacccgcatcatcccgcgccacttgcagctggccatccgcaacgacgaggagctcaacaagctgcttggtaaagttaccatcgctcagggcggtgttctgcctaacatccaggccgtactgctccccaagaagactgagagccaccacaaagctaagggcaagtaagggctgaactttaaaaatgtaaacttacaagacaaaaggctcttttcagagccacccaccatttctacggaagaactgagcactctgttctccaaacctatcagaaatttgtggccgagttcaagcactgaggccattactttcctattgggtaaaataaaagtattgaatcaggcctagtaaatactatccaactgctaccttataacatgaaggaacctccttaattgtcccctccccacaaactgtcctgggtctttaaaaaacttggggccgggcgcggtggtttatgcgtccttagcattttgggaaactgaggcag

SEQ ID NO: 354554 - DNA, 1793 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354555 - DNA, 2219 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttaaaaaaaaaacaaacaaagaaaacaaagaaaagaaaaaaaaaaaaaaaacaaaacaacagaaacaaaagaacaacaagacaacaaaaaagagggggcgcgcgcgccgccccaagaggctccccccgcgggggggcccccactactcaccgctaacacccccacttatgttgtgacaaaaagaagaggggcgccccccacaaagcagaagagagagatccgctacttataataaaaagaagaaaagaccgaggggcgaccccgcgtattataaaaaaaaaccgaggacgagaggcagggaagaagaaaacacgacgcacaaaagcaggagcaaaaacatattgataagagagaaaacaaccaacatcacacgcgggagggggaggacaaaacaactactgggagacaaaaaaactacaccagcagaa

SEQ ID NO: 354556 - DNA, 1812 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtggggtgtggctgcccctgccagtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354557 - DNA, 1589 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354558 - DNA, 1845 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggaaaggcatcttccccaagaactgtccagcattacttcctgagcttgctccagactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354559 - DNA, 1468 bp, Homo sapiens
tccttgactgtagcttagtcacatggccacgcctcgctggcagggaggcaagcgaaggtctttttcacacctagtggcaatatggtcagctgaaaatggacaccagcaaagaaggggagaagcgcaaccgtagtctgcctcagctctacagcaggatttaagctctggagtcagactgagttgtaatcctagctctgccctcttgaacaagttacttaatcttgctgtgccttggtttcctcgttttacaaatagcgtcatctcatagagtttttctgagagggaaatgtgaaatgctgcctccagtgcctgcacagtgtctgctacatgtcagctcttaccctggggaaaaggctggtctgtgtgtttgctgcttagacagtggcagtcgtgttctctagaagagcctggagatcaggaagactgaactgctgcgtgctcgtttctggcaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354560 - DNA, 1618 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354561 - DNA, 825 bp, Homo sapiens
tcgacttccactaagtgaggatgcctccaggtgccaggggagtgggtcgtgtcaggttggcgagaggcttcccaatggcccaaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354562 - DNA, 1143 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcaggtgaggacgtccgggttctggccgagccactcgccactcagggccggaggcggggcggggagccgcggggaaggaggggcggccgggctggtatcccagcctcctgggaactgcctggaccgtcgtcgcgcccgagtgcatcgcgttcttgctggagggcggatgcgccctgccttcctctgactcgctggcggcctcggaaacgctactcccgcgggagagcgctcgtgggacggcctgggccaggctgcttgtcagcccctgcgcttcccggcagtttccgcgtccctgttttccctgcgcgtcttctgatttccaccatgaggacgtttgggtcgtgattttcatctgcatgtggaggaaactgggccgcgcgccgggagccgcgcctgcgggtgctccgcccccaagtgcctgtgggtttggtgcgggccttgggttcagttcagctcgctgtgacctcgactgagcgctggaggctccgcgggcgggagcaggagggctggagccggcgcctgctgtgtgcccggcgcggtagtgatgtgtgagcctccccgcaacttctgagaaggtgtgaccttgtgtggtcaggaagccgaagcttgacgagttttcaagtacgttttctcaggtcctgcagctgggagacggcacaggacactaaaccaggttggtcagatccacggctctcacgctcccttgggccgttttgccttttctggaaaaaggaatcactttgtcttctaaacgcacaagtaatattttacattaacatacggatttcacagtaatccttgcattttttttttttagacggcatctctgtcaccaggttggagtgcagtggcgcaatctctgctcactgcaacctccgcctcccgggctgaggcaggagaagcccttgaacctgggagggaggttgcggtgagcggagatcgggccattgcactccagcccgggcaacagatcctgactcttatcaaaaa

SEQ ID NO: 354563 - DNA, 447 bp, Homo sapiens
atttttatgatttttaaatatggagcagctaaggttcaaagcagctgagtgacttggccagtgtcacatagctagacgtgaccaaggtggaagtttgaaattagaatatgttgataaaaggacttacaaactgtcaggatataaatataaggaaatatcgcccttatttataactgttgtattggctctagcatctctgcagagtcccgaaatgtctccaagtgactcttccggtagagcagaaaaagaagaatgcaggatgacagagtttgagcacgagctttagaattgaatcctgtgcagtctgttagcggcttcacttaaggcaatttacatagctttccaagctcagtttccccatctatgtaatggatctattacttgtaatcccagctactcgggaggctgaggcaggagaagcccttgaacctgggagggaggttgcgg

SEQ ID NO: 354564 - DNA, 1813 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctgactcttgtga

SEQ ID NO: 354565 - DNA, 1735 bp, Homo sapiens
ctggtggaccagctggctcctaaagaggagaggggactaaatcatgtatgcttggttctttcttcccagcttctctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgttcatgatgctgactcttgtga

SEQ ID NO: 354566 - DNA, 2462 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcaggtgaggacgtccgggttctggccgagccactcgccactcagggccggaggcggggcggggagccgcggggaaggaggggcggccgggctggtatcccagcctcctgggaactgcctggaccgtcgtcgcgcccgagtgcatcgcgttcttgctggagggcggatgcgccctgccttcctctgactcgctggcggcctcggaaacgctactcccgcgggagagcgctcgtgggacggcctgggccaggctgcttgtcagcccctgcgcttcccggcagtttccgcgtccctgttttccctgcgcgtcttctgatttccaccatgaggacgtttgggtcgtgattttcatctgcatgtggaggaaactgggccgcgcgccgggagccgcgcctgcgggtgctccgcccccaagtgcctgtgggtttggtgcgggccttgggttcagttcagctcgctgtgacctcgactgagcgctggaggctccgcgggcgggagcaggagggctggagccggcgcctgctgtgtgcccggcgcggtagtgatgtgtgagcctccccgcaacttctgagaaggtgtgaccttgtgtggtcaggaagccgaagcttgacgagttttcaagtacgttttctcaggtcctgcagctgggagacggcacaggacactaaaccagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354567 - DNA, 2258 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcaggtgaggacgtccgggttctggccgagccactcgccactcagggccggaggcggggcggggagccgcggggaaggaggggcggccgggctggtatcccagcctcctgggaactgcctggaccgtcgtcgcgcccgagtgcatcgcgttcttgctggagggcggatgcgccctgccttcctctgactcgctggcggcctcggaaacgctactcccgcgggagagcgctcgtgggacggcctgggccaggctgcttgtcagcccctgcgcttcccggcagtttccgcgtccctgttttccctgcgcgtcttctgatttccaccatgaggacgtttgggtcgtgattttcatctgcatgtggaggaaactgggccgcgcgccgggagccgcgcctgcgggtgctccgcccccaagtgcctgtgggtttggtgcgggccttgggttcagttcagctcgctgtgacctcgactgagcgctggaggctccgcgggcgggagcaggagggctggagccggcgcctgctgtgtgcccggcgcggtagtgatgtgtgagcctccccgcaacttctgagaaggtgtgaccttgtgtggtcaggaagccgaagcttgacgagttttcaagtacgttttctcaggtcctgcagctgggagacggcacaggacactaaaccaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354568 - DNA, 1508 bp, Homo sapiens
ttgtgtcctctcccaccagagaaagacagctgaccacccttcctcctggtgacttcacccatggtgtcctgcctgttctgtggccccacctggccattgtcttttcgcctttcttgcatctttctcagtcctctccagctttcccttggcttgggcttgaccacgggtgtggggtctgtggagtgtgtctcccctcccctcccagcaccctggaggtggggttgtggttctcctggagtggaaggcgacttgtgttgatagcctctcctttgtctctctgcagcccctcccgaggaatgacttcccccgcattgaaggggtgctcctcctaggggagccggtccgctgggagaccagcctgcagctgatcatggatgtcctcctcagcaatgggagccctggggctggcctggcaacacccccctacccccacctccccgtcctagccagcaacatggatctcctgtggatggctgaagccaagatgcccaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354569 - DNA, 1670 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggaaaggcatcttccccaagaactgtccagcattacttcctgagcttgctccagactgggcttccgaaatgtcgtcaccgtggatgagctgcggatggcctttcctctgcttgacatggtggacctggagcggcggctaaagaccacgcccctcccgaggaatgacttcccccgcattgaaggtttggacatggcacctttctgctgtgcctggaaaccatttaccagaaagtgacgggcaaggagctgagatacgagggcctgatgggcaaacccagcatcctcacttaccagtatgccgaggacctgatcaggcgacaggcggagaggcggggctgggccgcccccatccggaagctctatgctgtgggtgataaccctatgtctgacgtatacggcgccaacctgttccaccagtacctgcagaaggcaacgcatgatggggcgccagaactaggggccgggggcacacggcagcaacagccctcagcaagccagagctgcatctccatcctggtgtgtacaggcgtctacaatcccaggaacccacagtccacggagcctgtccttggaggaggggagcctccattccacgggcaccgagacttatgcttcagtccagggctcatggaggcctcccacgtggtgaatgacgtgaatgaggctgtgcagctggtcttccgcaaggagggctgggctttggagtgagggcagtgcggtggaggtgagggggtgagcctggacctgtgggcgagtcccattggctgggctctggcctgatcactgggctcaggtcagggcttggttcccttgccacccttcttgctgccccatgagtgtggcattactggtcacttggaagaagacagtgactctttttccctgctgggtagcattttgtatggaacggttggaattttctgggcccagttcccacgtgcctttcgtggcagtctaacctcaggccattctcttcccctgtgtgcctcagtgtccttctcatttcagtagggacttctgaaatgggggaggcagtgtggaatactgtggatgtctgtgcagagcctttgccggcactgaaggcatgcagcctgtcggcagagtgtcttaacaccagatgctactttttactgtattgtagtttattgcccggagatgtggggctttttttttaaataaaataatcataataaatgtt

SEQ ID NO: 354570 - DNA, 1832 bp, Homo sapiens
acgccgtgcacgtgcgcacggcgacggccggatggctgcgtggggctgtgtggctgcgctcggcgcggcgcgtgggctttgctggcgggcggcgcgcgcggctgcggggctccagggccgccccgcccgcaggtgctatgctgtgggccccgctcaggtgaggacgtccgggttctggccgagccactcgccactcagggccggaggcggggcggggagccgcggggaaggaggggcggccgggctggtatcccagcctcctgggaactgcctggaccgtcgtcgcgcccgagtgcatcgcgttcttgctggagggcggatgcgccctgccttcctctgactcgctggcggcctcggaaacgctactcccgcgggagagcgctcgtgggacggcctgggccaggctgcttgtcagcccctgcgcttcccggcagtttccgcgtccctgttttccctgcgcgtcttctgatttccaccatgaggacgtttgggtcgtgattttcatctgcatgtggaggaaactgggccgcgcgccgggagccgcgcctgcgggtgctccgcccccaagtgcctgtgggtttggtgcgggccttgggttcagttcagctcgctgtgacctcgactgagcgctggaggctccgcgggcgggagcaggagggctggagccggcgcctgctgtgtgcccggcgcggtagtgatgtgtgagcctccccgcaacttctgagaaggtgtgaccttgtgtggtcaggaagccgaagcttgacgagttttcaagtacgttttctcaggtcctgcagctgggagacggcacaggacactaaaccagagcccacccacctttgggttcctgttggacatcgatggagtgcttgtgcggggccacagagtgatccctgctgctctgaaagccttccgaaggctggtgaactcccaggggcagctgcgggtgcccgtggtttttgttacaaatgctggtaacatcttacaacacagcaaagcccaggagctgtcagccctgctggggtgcgaggtggatgcagaccaagttatcctctctcacagccccatgaagctcttctccgagtaccatgagaagcggatgctggtgtctggacaggggcccgtgatggaaaatgcccagggactgggcttccgaaatgtcgtcaccgtggatgagctgcggatggcctttcctctgcttgacatggtggacctggagcggcggctaaagaccacgcccctcccgaggaatgacttcccccgcattgaagagacgggctctcactatgttgcccaggctggtctcaaactcctgagctcaagcaatcctaccaccttggcctcccaaagtgctggaattacagacacaagccaccgcacgcagccatgggatggtttttttaaaaattaattttagtgtgggatagtttttgattgcacaggattgtcctgagtatgtagcgtccctggccccctcccacaaccttcacttgctaggttctagtcattgtgacaactaaaattgcctctgatttgtaaagcacctcagcaggggcggtgctgccccatggagaatcactggtctggtgcagttcaccggccctgtaccttagtgtcagcagtgttctttgcctagtgcttactgtgtgtctagtcctgggctgtttaccgatgatgtagctcatttttatcctcacaatagctaagtgctgttgctgttatgtagttgcagttgaggaaactgaggcttagagaagagaagttacttggccacagtcatacaggagaatcggtggagtccaggttgggtttcaagtctctatcactccaca

SEQ ID NO: 354571 - DNA, 687 bp, Homo sapiens
ctgcagggctgctttccttatggtgagtgcacaggagtccacgggcctgggcagctcatgttcactgattattgtcctactctgggagattcagtttatttctagatttttcaatgacaaccatgccataaagaacaccccatatacacttggtcgggtcattttgtaagctggactcccaggattgaattgctgggtgagcatgttttacattttggtggatgctgccatcttgttctcccaaaggcccgtgccagagcttatgccctccccagggtggctagcaggcctgtttccattctacccagcccacacatttttttaaactttcattttgaaatgattttagactcacacagaagttgcaaacatagtacagccattggttgtacactttctggacacaaaaaagggtatacttggtgtacccttcacccagcgtcccccagagatggcttcccacctaaccacaggacaaagatcaaagccaggagattgcctttggtacaatactattaagtaagctttatttggattttgccagattttacatgcgcttttttttttcttttggtgaatagttctatgatattttatgacgtgtataaatttgccacaaagctattaaacttaccacgtattaggtttgagtataataaatatgctttttttctttctctgtgcaat

SEQ ID NO: 354572 - DNA, 2200 bp, Homo sapiens
gtgcgcgtgcgctcgagagcgtcatcgcccccgactgtggagaagtgtccggggtagccccgttacaggtatcgctggctaccctcctccttcgcccctcctttcctcctttacattcaaatcaagtcggggttgaatttcgagaggggagtccgaggacctggggcctgatttctttttctctcgccatgcttcttcgggctgtgtacatgtgtggtggtgcctgagaggcgatacagggaatggctacactcttttactcccgcccctggccttcgtagtacccttgaagtgatccactagtcgtaacccctccttccaccaatgattcaattggagaagtttagaggagtggaaagacttgtccccttcccccatcgcaagcttggtcacagagtgtattgccaacccatgtatccagacgctcagtctagggctcttggccctgggtagcgttttgaaaaggctggttatccttaagtactgaagattgataaagcccacttacttacttaaaagaatatgccctgaaatgtgttttctgtgccactgacaccagaaatgctatttagaagaagttatcagtaatcctgacaaaggatgcttcctgcagctcaaatcaggctggaggtgcctttatatttttcattgaattactgttttggtgactcgaatgaatcatcaattcatttatttgtcttcaaatgtctgacggcacttaaggtctaaaaaagaaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctgatgtgatggtggctggaggtacagattcttgtattagccctttatctcttgctgggttttccagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatttttaaatgttaaaaaaaaaaaat

SEQ ID NO: 354573 - DNA, 1669 bp, Homo sapiens
ttggccgggtcccgaggcccctggccggcgggctcggacgttaggagcagaaccagctccaggtcccggtctgtccgggcgtcgctgccctctgaagctcaggccggacgccccagtccctggccgaacaaggtgccgcggcccacccaccccggtacccgccgtccgaccccgttgccctgcacctgaggatgttgtcagcataggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctgatgtgatggtggctggaggtacagattcttgtattagccctttatctcttgctgggttttccagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatttttaaatgttaaaaaaaaaaaat

SEQ ID NO: 354574 - DNA, 882 bp, Homo sapiens
gcatgagcgtacgtgcgtgtgcgcgtgcgctcgagagcgtcatcgcccccgactgtggagaagtgtccggggtagccccgttacaggtatcgctggctaccctcctccttcgcccctcctttcctcctttacattcaaatcaagtcggggttgaatttcgagaggggagtccgaggacctggggcctgatttctttttctctcgccatgcttcttcgggctgtgtacatgtgtggtggtgcctgagaggcgatacagggaatggctacactcttttactcccgcccctggccttcgtagtacccttgaagtgatccactagtcgtaacccctccttccaccaatgattcaattggagaagtttagaggagtggaaagacttgtccccttcccccatcgcaagcttggtcacagagtgtattgccaacccatgtatccagacgctcagtctagggctcttggccctgggtagcgttttgaaaaggctggttatccttaagtactgaagattgataaagcccacttacttacttaaaagaatatgccctgaaatgtgttttctgtgccactgacaccagaaatgctatttagaagaagttatcagtaatcctgacaaaggatgcttcctgcagctcaaatcaggctggaggtgcctttatatttttcattgaattactgttttggtgactcgaatgaatcatcaattcatttatttgtcttcaaatgtctgacggcacttaaggtctaaaaaagaaggtaagtttaaacagatagtttgatgttaaggtataaattgaaagtatgtaacattttccctgtgttcattagcagctcatatcaagcacccaaaggaacaccttggatgtttttccttaggccctta

SEQ ID NO: 354575 - DNA, 304 bp, Homo sapiens
cctacatttgtttcacataagccatacagataaagagacttttgttaaaattaaacttagtcctgataaatgtcttttcttgttttattaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttt

SEQ ID NO: 354576 - DNA, 1531 bp, Homo sapiens
gtgcgcgtgcgctcgagagcgtcatcgcccccgactgtggagaagtgtccggggtagccccgttacaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctgatgtgatggtggctggaggtacagattcttgtattagccctttatctcttgctgggttttccagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatttttaaatgttaaaaaaaaaaaat

SEQ ID NO: 354577 - DNA, 1077 bp, Homo sapiens
gtgcgcgtgcgctcgagagcgtcatcgcccccgactgtggagaagtgtccggggtagccccgttacaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatttttaaatgttaaaaaaaaaaaat

SEQ ID NO: 354578 - DNA, 403 bp, Homo sapiens
cctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatttttaaatg

SEQ ID NO: 354579 - DNA, 715 bp, Homo sapiens
attaaaccttcacatttgtttggtttcagatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgta

SEQ ID NO: 354580 - DNA, 5325 bp, Homo sapiens
  misc_feature (2863)..(2863): n is a, c, g, or t
  misc_feature (2979)..(2979): n is a, c, g, or t
gggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaagattatgttttacttatctcaaaggagatacatataatttataatgatatgggcagttgcttccagggacatcaacaaagctgcttagatataatattagataaatataacagaccactctgtattaatggattaaagccagctagttaaacaaccctttttaaccataatcatggaagctttattcttgcaataaagatttttaggctgggcgcagtgnctcacacctgtaatcccagcactttgggaagctaaggcaggcagatcatttgaggtcaggagtttgagaccagcctggccaacatggtgaaaccccatctctgctaaaattacaanaaagttagccgggcatggtggtgtgcacctgtaatcccagctactcgggaggctgaggcaggagaatcacttgaacccgggaggcagaggttgcagtgagccgagatcatgtcactgcactctagcttgggagacagagcgagactccgtctcaaaaaacaaacaaacaaataaaacacccatttttaacaaaacaactttatatagcatacagccatgattctaaatagtatgattatggttctcaggatctgactacataggtaaaaatatttgcatatgtgtatgaagtgttgggggatgtaggctagaattgtagtctgtgttctaattttggttctaccaccaattagctgtatgacctttagcaagtcctttaacttttcttagattccagggactcatttataaaatgacatggacaaaagcatctctaatcactctaaaagatttgaagtctaggacctaaattctaaatactcttttgaggagtgactgagttttcattttcataattatgtctctcagaggacaaatttacattttcttaacagagacattttcttcttctttttttttgtttgagacagagtctcgctctgtcgtccaggctggagtgcagtgctgcaatcttggctcactgcaacctgcgcctcctgggttcaagtgattcttctgcctcaacctcccaagtagctagacctataggcgcctgccaccatgcccagctaatttttgtatttttagtagagacagggtttcatattggccagactggtctcgaactcctgaccttgtgatccgcccacctcggcctcccaaagtgctgggattacaggtgtgagccaccacacccagccaacattttcctcttttaaaaaatatcttctcacgcctgtaatcccagcactttgggaggctgaggcaggcggatcatgaggtcaggagatcaagaccatcctggctaacacggtgaaactccatctctactaaaaatacaaaaaaaatagccgggcgtggtggcaggcgcctgtagtcccagctactggggaggctgaggcaggaaaatggtgtcaacccgggaggcggagcttgcagtgagccgagattgcgccactgcactccagcctgggcaatagagtgagactccgtctcaaaaaaaaaaaaaaaaaaaaaaacttcaacaataccctcaggttgataattttggatatctatctgtatctatatatcttgtttacctggtctccagaaaaagaacacatacacatatccatatataaaatatgtatacatgtatcaaatctacgtaaactataaaggtgggatggctttaattatggcccaagctactaagacaatgaagactttttggggctgcaagctactgcttcccttctttatctactagcctcttaaacaaggctcacttgtgctacaagacagtccaccgttttgttttttttttcttttttttgagacagggtctcactctttcccaggctgcagtacagtgacacagtctcagctcactgcagctttgaccttgccgggctcaggtgacccttacacttcagcctcccaagtagcagggactataggtgtgcaccaacatgcttggttaatttttgtattttttgtagagacagggttttgccatgttgtccaggctagtctcgaattcctgggctcaagtgattcacctgccttggcctcccaaagtgctaggattacagatgggagccaccacgcccagcccagtccagctcttatatgtagcacagggaaaggacaaatacttgtcaactataaataagaaacattgctaatgcattgcaaagaacactagtttcatttactttataacttagatgtctactgggtgagacgaatgtctttgttctttaaaaaataggaaaagagaagaaaaactagcataacataagtactcatttgtaagactttctgacatgtaacattagttccgtagttttgagacctggtagaactgactttcatatttggataacctggaaaacacccaaacacaaacttcaagtcttctttctcttttttcattatcttttttagtctgaggtgacaccatcattaaggattcgacacccgtttgtaaataaaatgacatcagcaattactctgaaatgtttctagtttgcaaagacttagcaatgtgatgttattaacccttcctcccttcagagacctgtcctaagctctgaaccactcattccttccactcttcttaccccaggtggttgatgagcagtggtccctggtgttccacaaagagtcattaaagtgttacagctggtagcactggtagca

SEQ ID NO: 354581 - DNA, 2753 bp, Homo sapiens
gggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagcctcatctgtatcctcttgtgatggcgtgaaggaaagccatggcagatttccagcctggtgatgctgtacagaacacaggtggcctgcttccatgcctcctcagcttcaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgta

SEQ ID NO: 354582 - DNA, 5436 bp, Homo sapiens
  misc_feature (2974)..(2974): n is a, c, g, or t
  misc_feature (3090)..(3090): n is a, c, g, or t
gggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagcctcatctgtatcctcttgtgatggcgtgaaggaaagccatggcagatttccagcctggtgatgctgtacagaacacaggtggcctgcttccatgcctcctcagcttcaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaagattatgttttacttatctcaaaggagatacatataatttataatgatatgggcagttgcttccagggacatcaacaaagctgcttagatataatattagataaatataacagaccactctgtattaatggattaaagccagctagttaaacaaccctttttaaccataatcatggaagctttattcttgcaataaagatttttaggctgggcgcagtgnctcacacctgtaatcccagcactttgggaagctaaggcaggcagatcatttgaggtcaggagtttgagaccagcctggccaacatggtgaaaccccatctctgctaaaattacaanaaagttagccgggcatggtggtgtgcacctgtaatcccagctactcgggaggctgaggcaggagaatcacttgaacccgggaggcagaggttgcagtgagccgagatcatgtcactgcactctagcttgggagacagagcgagactccgtctcaaaaaacaaacaaacaaataaaacacccatttttaacaaaacaactttatatagcatacagccatgattctaaatagtatgattatggttctcaggatctgactacataggtaaaaatatttgcatatgtgtatgaagtgttgggggatgtaggctagaattgtagtctgtgttctaattttggttctaccaccaattagctgtatgacctttagcaagtcctttaacttttcttagattccagggactcatttataaaatgacatggacaaaagcatctctaatcactctaaaagatttgaagtctaggacctaaattctaaatactcttttgaggagtgactgagttttcattttcataattatgtctctcagaggacaaatttacattttcttaacagagacattttcttcttctttttttttgtttgagacagagtctcgctctgtcgtccaggctggagtgcagtgctgcaatcttggctcactgcaacctgcgcctcctgggttcaagtgattcttctgcctcaacctcccaagtagctagacctataggcgcctgccaccatgcccagctaatttttgtatttttagtagagacagggtttcatattggccagactggtctcgaactcctgaccttgtgatccgcccacctcggcctcccaaagtgctgggattacaggtgtgagccaccacacccagccaacattttcctcttttaaaaaatatcttctcacgcctgtaatcccagcactttgggaggctgaggcaggcggatcatgaggtcaggagatcaagaccatcctggctaacacggtgaaactccatctctactaaaaatacaaaaaaaatagccgggcgtggtggcaggcgcctgtagtcccagctactggggaggctgaggcaggaaaatggtgtcaacccgggaggcggagcttgcagtgagccgagattgcgccactgcactccagcctgggcaatagagtgagactccgtctcaaaaaaaaaaaaaaaaaaaaaaacttcaacaataccctcaggttgataattttggatatctatctgtatctatatatcttgtttacctggtctccagaaaaagaacacatacacatatccatatataaaatatgtatacatgtatcaaatctacgtaaactataaaggtgggatggctttaattatggcccaagctactaagacaatgaagactttttggggctgcaagctactgcttcccttctttatctactagcctcttaaacaaggctcacttgtgctacaagacagtccaccgttttgttttttttttcttttttttgagacagggtctcactctttcccaggctgcagtacagtgacacagtctcagctcactgcagctttgaccttgccgggctcaggtgacccttacacttcagcctcccaagtagcagggactataggtgtgcaccaacatgcttggttaatttttgtattttttgtagagacagggttttgccatgttgtccaggctagtctcgaattcctgggctcaagtgattcacctgccttggcctcccaaagtgctaggattacagatgggagccaccacgcccagcccagtccagctcttatatgtagcacagggaaaggacaaatacttgtcaactataaataagaaacattgctaatgcattgcaaagaacactagtttcatttactttataacttagatgtctactgggtgagacgaatgtctttgttctttaaaaaataggaaaagagaagaaaaactagcataacataagtactcatttgtaagactttctgacatgtaacattagttccgtagttttgagacctggtagaactgactttcatatttggataacctggaaaacacccaaacacaaacttcaagtcttctttctcttttttcattatcttttttagtctgaggtgacaccatcattaaggattcgacacccgtttgtaaataaaatgacatcagcaattactctgaaatgtttctagtttgcaaagacttagcaatgtgatgttattaacccttcctcccttcagagacctgtcctaagctctgaaccactcattccttccactcttcttaccccaggtggttgatgagcagtggtccctggtgttccacaaagagtcattaaagtgttacagctggtagcactggtagca

SEQ ID NO: 354583 - DNA, 2300 bp, Homo sapiens
gtgagagaacgtggccggacgaccagaagcggctgagagtcgactacgctccgcgaggacacgctgtgtctgtgcgctggtgcatctaccaaactagaatgtcagcgaatgcattcctgatggatgtcgctcgactcacaagcaatagccgcaaggtcagatgttcgcatgagaagccgaccctcgcgcaggaagtgattgcccgcgaacaggagcgagagtcgaccagccacgctgtgtgccgatgatagtgaggacacgatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgta

SEQ ID NO: 354584 - DNA, 2368 bp, Homo sapiens
gggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggccccacagagagagcgtcagctgaggaccatcgtggggatccttagatcgacctcagcacac

SEQ ID NO: 354585 - DNA, 1166 bp, Homo sapiens
ataggaaagaaggaaatgaaggcggagagtggggagagagcagcagaattcaatttaatctgaggccaccccaagtgttttgtagaattgggctgaagaggtttcctaggcagcctcgcaggctgcacagcacaccacccccgaggtgcccacgtgcagccccgtgatttgttctccactgacagaatctataccggccactgggacacgttgtgctttaacaagatcgaaattgattgctgccagcgtgtccgtgtcggctgcttcttttggagggagccagtgggggacgggagtctcagcaggctggggtgttgcacttttccttttgtctgcagcctgatgtttgctttgtgctgaaggaagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgta

SEQ ID NO: 354586 - DNA, 1647 bp, Homo sapiens
gggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatgtaagtgatctttacctcctctgggcattctgggctgggtgactgaagaaacaagggcctcacatcaatgcttcgtgtcactaggctggcatgaacaggtcagaatgcagggagggcattctgcttctcttaggggctttccatgtgtggctggatttgcaaagggcctgcagagaatgctttttcttagcctaaagcctgtcccacttggagtctccttctctagggacctttaaggacaaaatgggttcctctgtctgggttagtttaacaaacctgcctagaagcagagagatgaccaaaatgatttctagaaaatgtattttttgttctaatct

SEQ ID NO: 354587 - DNA, 390 bp, Homo sapiens
ggaaatgaaggcggagagtggggagagagcagcagaattcaatttaatctgaggccaccccaagtgttttgtagaattgggctgaagaggtttcctaggcagcctcgcaggctgcacagcacaccacccccgaggtgcccacgtgcagccccgtgatttgttctccactgacagaatctataccggccactgggacacgttgtgctttaacaagatcgaaattgattgctgccagcgtgtccgtgtcggctgcttcttttggagggagccagtgggggacgggagtctcagcaggctggggtgttgcacttttccttttgtctgcagcctgatgtttgctttgtgctgaagggtctgttcctactgactgtgctaatgtgtacacgcaga

SEQ ID NO: 354588 - DNA, 549 bp, Homo sapiens
ttttttgaaaagttttttgagctctccagctggaataccaaactggtgatttcgcagatgtttttatttaggacaaaaaaaagtgaatttcgtgaaaacactcaagtaattaacagtagagaaatacggcaaacatcacagaggtggtaacagatatctggacccctcagctgggatcaagacacaaatgagcatggagcttatgactcctttcacacgaaggagctagagttgatgttccctgttgtctttgttgtcttcacctacagatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccagtaagtatgacaggcccaaccttcaggcatttttaacatggaaaggaattatgccaatgcaatgaagatgtaacagaattctctata

SEQ ID NO: 354589 - DNA, 2642 bp, Homo sapiens
gggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgta

SEQ ID NO: 354590 - DNA, 619 bp, Homo sapiens
atgtctgtatatcctccacacggtttatacatatacaagcagatatgcacacagaaacacacattctcctctcgttttttacacaaaatagcagcatagtatgcacactgctctgcgcctggcttttaaaaaaaaactcaatatatcttagagatcattccatatcagttactaagatttatttcttcatgtattccaagcacacacgaagcagcccacattatgataatttctctttcctcaatactgggcagttgattttcatctgtgttttccccttgctggtgaatgatttctaccacaggatggtccaatcacattctttgaattgccttccagataaaatatcttaataaacattagtgctttggcctggaggataagtaaacaattttatgtgattagggctttgcaagcacattggtgtctcactgttaatttaaaccacatcttgaatgaggtcccttaaggtcataaagtgaggactccaagaatttatctgtcttctaaggctatagcatgttttctcttgttccagaaactagaatgaaccgaagcattcctgtggaggttgatgaatcagtacgctggaatggaattgggggacctctagagtcga

SEQ ID NO: 354591 - DNA, 3391 bp, Homo sapiens
gggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaagattatgttttacttatctcaaaggagatacatataatttataatgatatgggcagttgcttccagggacatcaacaaagctgcttagatataatattagataaatataacagaccactctgtattaatggattacagatgggagccaccacgcccagcccagtccagctcttatatgtagcacagggaaaggacaaatacttgtcaactataaataagaaacattgctaatgcattgcaaagaacactagtttcatttactttataacttagatgtctactgggtgagacgaatgtctttgttctttaaaaaataggaaaagagaagaaaaactagcataacataagtactcatttgtaagactttctgacatgtaacattagttccgtagttttgagacctggtagaactgactttcatatttggataacctggaaaacacccaaacacaaacttcaagtcttctttctcttttttcattatcttttttagtctgaggtgacaccatcattaaggattcgacacccgtttgtaaataaaatgacatcagcaattactctgaaatgtttctagtttgcaaagacttagcaatgtgatgttattaacccttcctcccttcagagacctgtcctaagctctgaaccactcattccttccactcttcttaccccaggtggttgatgagcagtggtccctggtgttccacaaagagtcattaaagtgttacagctggtagcactggtagca

SEQ ID NO: 354592 - DNA, 2567 bp, Homo sapiens
gggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccaagaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgta

SEQ ID NO: 354593 - DNA, 948 bp, Homo sapiens
ataggaaagaaggaaatgaaggcggagagtggggagagagcagcagaattcaatttaatctgaggccaccccaagtgttttgtagaattgggctgaagaggtttcctaggcagcctcgcaggctgcacagcacaccacccccgagaagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgta

SEQ ID NO: 354594 - DNA, 1114 bp, Homo sapiens
ataggaaagaaggaaatgaaggcggagagtggggagagagcagcagaattcaatttaatctgaggccaccccaagtgttttgtagaattgggctgaagaggtttcctaggcagcctcgcaggctgcacagcacaccacccccgaggtgcccacgtgcagccccgtgatttgttctccactgacagaatctataccggccactgggacacgttgtgctttaacaagatcgaaattgattgctgccagcgtgtccgtgtcggctgcttcttttggagggagccagtgggggacgggagtctcagcaggctgggaagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgta

SEQ ID NO: 354595 - DNA, 379 bp, Homo sapiens
atgtgtctatgaggaggggtcaggttatagagtttatatgagggtttgaggaattcgattcgtggtcggaaccagtttctgtgagttttgccacatttggtcttgcagtatttcagcagtgcctgggaatggctaagccctcagcttgggctcaagccttcaaggcaaaacttgcagctgtccaggtcacagaactgtgaaggcaccctgtgtttctcagcacaaagaaagaaagtgggaggaactagggggcaaactcttgtttgcctttctccaataaaataaatttgagagcaagacctaatctgtcttattctgtgactatcacaggacctagcacttagttagatattcaataaatagggcgccaaatgaatgc

SEQ ID NO: 354596 - DNA, 5485 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcctatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaatataatttga

SEQ ID NO: 354597 - DNA, 1723 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtggaaccagatggcacaggcctcacctgcagcctggcacccaatatcatctcacagctctgaggccctgggccagattacttcctccacccctccctatctcacctgcccagccctgtgctggggccctgcaattggaatgttggccagatttttgcaataaacacttgtggtttgcggcc

SEQ ID NO: 354598 - DNA, 999 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatgtgagtgactgttactcctgttattcttcctatagctgagaaggttcatctagaccttgatattggg

SEQ ID NO: 354599 - DNA, 369 bp, Homo sapiens
tgttccttctggctcctataggatggacactccacagctgaccttgactgaactccgggtccttcttgagcagatgggcagcctgccctgtgccatgcatcagattggggatgtcaaggttctttcctggaagtggcggagatatgtgttcccataccatctctgtgtgtacagcatgcaaggaaatatccttccagactgaaataattaaaaactctaaactgggcctacataagacactggctcttgggaatggggtggagaggactgattggttggttggttgatttccctccagacaccagagtcttagaaagcttactagatggataagattgtattaaagtgggtttggaaaaagaaatttag

SEQ ID NO: 354600 - DNA, 5119 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcctatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaatataatttga

SEQ ID NO: 354601 - DNA, 3027 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagggtattctcaaccttccttttctgctaacactgcctacctgttgcaacttacactctccaggctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggtacgtgagaggagaaggcaaagaagggtgtcagtgtgtgaaaatgaataacaaaaatggatagactataaacacacaatcctgtttgaggctgaggcaggagaattgtttgaacccaggagacagaggttgcagtgagccgagatggcatcattgcactccagcctgggcagcaagagcaaaactccatctcaaaacaacagc

SEQ ID NO: 354602 - DNA, 639 bp, Homo sapiens
cccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttgtaaggactcatgattttgtaatattctactttgaaccgtcaagattatattgaacctaaaatgaattcatcatacttttctttttttcttccttctttcttcttatttatgagcccttttatctgaagagacgggtggctagaaatgggaggaaatgttttcaagatagctaaagtcaaaagcaaaatttttatgtctttttagatagaacttttcaccaaactatactctgtttttcaactctattagcattttctgaacttttacagcttaatataggagataatgtgatccaatataaattatgttaaagagctgtttatttgtttttggcaaattcctccagactctcaaatcatcacatttcatatagtagtgacagttttctattatcttcttttacttttgtcccttgtatgtttacatcttcttttattctttctacatctcacttggaagatttttataatgtcttacatatttaagtctgcactacaaga

SEQ ID NO: 354603 - DNA, 5314 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggatgtcctggaacaggtggaggcctatcaagctgaggctcgtgaggctctggccacactgccctctagtccagggctattgcggtccctgttggagagggggcagcagctgggtgtagaggtgcctgaagcccatcagcttcagcagcaggtggagcaggcgcaatggctagatgaagtgaagcaggccctggccccttctgctcacaggggctctctggtcatcatgcaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcctatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaatataatttga

SEQ ID NO: 354604 - DNA, 5254 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggatggacactccacagctgaccttgactgaactccgggtccttcttgagcagatgggcagcctgccctgtgccatgcatcagattggggatgtcaaggggcttttggttatgggtgccaagatagcctccagcccttctgtggacaaggcccgggctgagctgcaagaactactgaccattgcagagcgctgggaagaaaaggctcatttctgcctggaggccaggcagaagcatccaccagccacattggaagccataattcgtgagacagaaaacatccctgttcacctgcctaacatccaggctctcaaagaagctctgactaaggcacaagcttggattgctgatgtggatgagatccaaaatggtgaccactacccctgtctagatgacttggagggcctggtggctgtgggccgggacctgcctgtggggctggaagagctgagacagctagagctgcaggtattgacagcacattcctggagagagaaggcctccaagacctttctcaagaagaattcttgctacacactgcttgaggtgctttgcccgtgtgcagacgctggctcagacagcaccaagcgtagccggtggatggagaaggcgctggggttgtaccagtgtgacacagagctgctggggctgtctgcacaggacctcagagacccaggctctgtgattgtggccttcaaggaaggggaacagaaggagaaggagggtatcctgcagctgcgtcgcaccaactcagccaagcccagtccactggcaccatccctcatggcctcttctccgacttctatctgtgtgtgtgggcaggtgccagctggggtgggagttctgcagtgtgacctgtgtcaggactggttccatgggcagtgtgtgtcagtgccccatctcctcacctctccaaagcccagtctcacttcatctccactgctagcctggtgggaatgggacacaaaattcctgtgtccactgtgtatgcgctcacgacggccacgcctagagacaatcctagccttgctggttgccctgcagaggctgcccgtgcggctgcctgagggtgaggcccttcagtgtctcacagagagggccattggctggcaagaccgtgccagaaaggctctggcctctgaagatgtgactgctctgttgcgacagctggctgagcttcgccaacagctacaggccaaacccagaccagaggaggcctcagtctacacttcagccactgcctgtgaccctatcagagaaggcagtggcaacaatatttctaaggtccaagggctgctggagaatggagacagtgtgaccagtcctgagaacatggctccaggaaagggctctgacctggagctactgtcctcactgttgccgcagttgactggccctgtgttggagctgcctgaggcaatccgggctcccctggaggagctcatgatggaaggggacctgcttgaggtgaccctggatgagaaccacagcatctggcagctgctgcaggctggacagcctccagacctggacagaattcgcacacttctggagctggaaaaatttgaacatcaagggagtcggacaaggagccgggctctggagaggcgacggcggcggcagaaggtggatcagggtagaaacgttgagaatcttgttcaacaggagcttcagtcaaaaagggctcggagctcagggattatgtctcaggtgggccgagaagaagaacattatcaggagaaagcagaccgtgaaaatatgttcctgacaccttccacagaccacagccctttcttgaaaggaaaccaaaatagcttacaacacaaggattcaggctcttcagctgcttgtccttctttaatgcctttgctacaactctcctactctgatgagcaacagttgtgacagtggcaccaaaggtcatttgtggttgtttttgtttgtttgtttcttaaatcctactatctcctggcctggacctcagaaggagctttttgcctatctataatttttcactgccaatttttgatatcctctctcctagagttactgttaaaaggttggttcgtaaagtccacaccccgatgctcagaagtgtcttgccagcaacattcctgctagcatacaggagtgatttcctaaaccagtttcattctagtctgaatagggacaaacaaatcttgaggaagcccaagtgcgtacctttatttttgcccccaccaccctctttctgtacttcaatttttgtttgttttttgtttttttgtccctgtcataaaatattttggtgcttcaaaacttgtaccttcattgtacatccttttcttttctccccttgggtcttattataaaagaagacaatgtacgttgtaattaccaaaaagaatagggaaaaacaagaatttcatgactctacctgtggtctatctttaatttcatttcttttgttaaaaataaaacaatgagtatgtttggatactatgaatataatttga

SEQ ID NO: 354605 - DNA, 3080 bp, Homo sapiens
ggacggccatactatttttatcttgctttttcgttctgtcgcagtactgtttaatatgagtccagcgacggctctgtgactgttttcctctggtaaaatcgctcttgcgtcctcagcgtttatctcaggtgcggaaggtctcacaggtttggaaatagcgccggaaaaatcgatccgcggagtgagacggctcgtaccacactgcagggcccggaggtcaagatggtggctgtaaaactaggatccctgacgattgcttagcattaaggcccgacatggaaccggggtgtgacgagttcctgccgccaccggagtgcccggtttttgagcctagctgggctgaattccaagacccgcttggctacattgcgaaaataaggcccatagcagagaagtctggcatctgcaaaatccgcccacccgcggattggcagcctccttttgcagtagaagttgacaatttcagatttactcctcgcgtccaaaggctaaatgaactggaggcccaaactagagtgaaattgaactatttggatcagattgcaaaattctgggaaattcaaggctcctctttaaagattcccaatgtggagcggaagatcttggacctctacagccttagtaagattgtgattgaggaaggtggctatgaagccatctgcaaggatcgtcggtgggctcgagttgcccagcgtctccactacccaccaggcaaaaacattggctccctgctacgatcacattacgaacgcattatttacccctatgaaatgtttcagtctggagccaaccatgtgcaatgtaacacacacccgtttgacaatgaggtaaaagataaggaatacaagccccacagcatcccccttagacagtctgtgcagccttcaaagttcagcagctacagtcgacgggcaaaaaggctacagcctgatccagagcctacagaggaggacattgagaagcatccagagctaaagaagttacagatatatgggccaggtcccaaaatgatgggcttgggccttatggctaaggataaggataagactgtgcataagaaagtcacatgccccccaactgttacggtgaaggatgagcaaagtggaggtgggaacgtgtcatcaacattgctcaagcagcacttgagcctagagccctgcactaagacaaccatgcaacttcgaaagaatcacagcagtgcccagtttattgactcatatatttgccaagtatgctcccgtggggatgaagatgataagcttcttttctgtgatggctgtgatgacaattaccacatcttctgcttgttaccaccccttcctgaaatccccagaggcatctggaggtgcccaaaatgtatcttggcggagtgtaaacagcctcctgaagcttttggatttgaacaggctacccaggagtacagtttgcagagttttggtgaaatggctgattccttcaagtccgactacttcaacatgcctgtacatatggtgcctacagaacttgtagagaaggaattctggaggctggtgagcagcattgaggaagacgtgacagttgaatatggagctgatattcattccaaagaatttggcagtggctttcctgtcagcaatagcaaacaaaacttatctcctgaggagaaggagtatgcgaccagtggttggaacctgaatgtgatgccagtgctagatcagtctgttctctgtcacatcaatgcagacatctcaggcatgaaggtgccctggctgtacgtgggcatggttttctcagcattttgttggcatattgaggatcactggagttactctattaactatctgcattggggtgagccgaagacctggtatggtgtaccctccctggcagcagagcatttggaggaggtgatgaagatgctgacacctgagctgtttgatagccagcctgatctcctacaccagcttgtcactctcatgaatcccaacactttgatgtcccatggtgtgccagttgtccgcacaaaccagtgtgcaggggagtttgtcatcacttttcctcgtgcttaccacagtggttttaaccaaggctacaattttgctgaagctgtcaacttttgtactgctgactggctacctgctggacgccagtgcattgaacactaccgccggctccggcgctattgtgtcttctcccacgaggagctcatctgcaagatggctgccttcccagagacgttggatctcaatctagcagtagctgtgcacaaggagatgttcattatggttcaggaggagcgacgtctacgaaaggcccttttggagaagggcgtcacggaggctgagcgagaggcttttgagctgctcccagatgatgaacgccagtgcatcaagtgcaagaccacgtgcttcttgtcagccctggcctgctacgactgcccagatggccttgtatgcctttcccacatcaatgacctctgcaagtgctctagtagccgacagtacctccggtatcggtacaccttggatgagctccccaccatgctgcataaactgaagattcgggctgagtcttttgacacctgggccaacaaagtgcgagtggccttggaggtggaggatggccgtaaacgcagtgagtgacaggaaatggaaggaacccttgtgtaagccttatttctttcttttgggtattctcaaccttccttttctgctaacactgcctacctgttgcaacttacactctccaggctttgaagagctaagggcactggagtctgaggctcgtgagaggaggtttcctaatagtgagctgcttcagcgactgaagaactgcctgagtgaggtggaggcttgtattgctcaagtcctggggctggtcagtggtcaggtggccaggtacgtgagaggagaaggcaaagaagggtgtcagtgtgtgaaaatgaataacaaaaatggatagactataaacacacaatcctgtttgaggctgaggcaggagaattgtttgaacccaggagacagaggttgcagtgagccgagatggcatcattgcactccagcctgggcagcaagagcaaaactccatctcaaaacaacagc

SEQ ID NO: 354606 - DNA, 1746 bp, Homo sapiens
gcggccgccctggccacgtcaccgcccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccaactgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacacctta

SEQ ID NO: 354607 - DNA, 525 bp, Homo sapiens
gcggccgccctggccacgtcaccgcccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggtgaggggcgcctggcagggaggtgcgggaccccctctctggccagcctcatgcccctgcgtgcagggcagggcgctccaggtgtctgctcagggtggggactccggcgtgggggtccttgaaactttgcggagctccacttccaaaaacaatgtaaagttgtataaaatcagaggaggaggacccctcgagatgatgggaggcgggtgggtttgttcctgcacagacgccccctca

SEQ ID NO: 354608 - DNA, 295 bp, Homo sapiens
cattaggttattggtattaaggtactaagtacaaggcaggtatcagccactggtttgaaaaaattcaaaccagtaaaagatgagtctcaaaactcctccagccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacacctta

SEQ ID NO: 354609 - DNA, 1693 bp, Homo sapiens
gcggccgccctggccacgtcaccgcccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccaactgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacacctta

SEQ ID NO: 354610 - DNA, 1285 bp, Homo sapiens
atggggcagttgcagttgatcaggaaaaaggctctaggtagaaagacatgtggacacaagttctaggacttgagaaggactgctgatttgattgtatgagatgtacaatagacaatttgaggccaatcgctaagtttacagctggggggaagggtgccagtaaccaagtcggggatcagtaggtccatagtcaaccggagatggactccccctttgctttaacaatcgaacatatactgtgagccggccattaagagatgataccaagattatgcatcaagttataaagcagtcctttcatcagatggtaaattcttatttcatctccattttcttccagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccaactgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacacctta

SEQ ID NO: 354611 - DNA, 1628 bp, Homo sapiens
gcggccgccctggccacgtcaccgcccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccaactgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtagcagtaccactaggtagcagtaccactaggtagcagtaccactaggtagcagta

SEQ ID NO: 354612 - DNA, 540 bp, Homo sapiens
aactgattaaaatattataatttttattgagaactttttccctccttactgtaccttctccagcaagctattgttttagtaattatgttcttttaagatgggcctcttcttggtcttgctcagtctctggttgctttctctttggctcagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagaca

SEQ ID NO: 354613 - DNA, 974 bp, Homo sapiens
gcggccgccctggccacgtcaccgcccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaaggtaggtcctgggatgacagcaatgctgacactggcctaaggagttactcatccatttaataagtattccagcagatacagatgtgaacagtcaagtctctgccatccacaatgcttgtgttctaatgcaagaagacaaatattttcaataaagaaacaaatgccataaaaaaa

SEQ ID NO: 354614 - DNA, 1991 bp, Homo sapiens
gcggccgccctggccacgtcaccgcccggccaagagtgcgtgggcggcggcgcgcgggtgcgatcgcggagctgtgaggcgcaggcagggctctggggcacctagagaccggggccggagacgtggcagccgccctgcccgccagaaagtttcctagaagtttgctgggcgcgggcgcacgactgactggctggaccatgaacgtgttccgaatcctcggcgacctgagccacctcctggccatgatcttgctgctggggaagatctggaggtccaagtgctgcaagggcatctctgggaagagccagatcctgtttgctctcgtcttcaccaccaggtacctggacctgttcaccaacttcatctccatctacaacacagtaatgaaggtggtttttctcctctgtgcctatgttacagtgtacatgatatatgggaaattccgtaaaacttttgacagtgagaatgacacattccgcctggagtttcttctggtcccagtcattggcctttccttccttgaaaactacagtttcactctgctggagatcctctggactttctctatctatctggaatcagtggctatcctgccccagctcttcatgatcagcaagactggagaggctgagaccataactactcactacctgttctttctgggtctgtaccgggcactctacctggctaactggatcaggcggtaccagactgagaatttctatgaccaaattgcagtcgtgtctggagtagtacaaaccatcttctactgtgacttcttctacttgtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaaacctgatcatcccacccagaagaccttctcatcaatagatcgcccttaaagacccattgtaaggtcataaaaaacctcggccaactgcacaaagatggtgcctcactgcaacaagaaaccttaaggtgtcttaccgacgaaataaaaaacataaatgattgttctccaaggcctgagggcaagactcatgatgagcaagtcaaccccaatctggaacaatgtccctcctcttagaatgtcccaactaaagaccagttaaaatattagggtacgttcttgtgaatttccactttccaggtagatgaccaaatttaggtggtcaagatataaaggtgtcagctagttttaagtgtgaaacttatttcactttcacactgccttcaggccagaagcaaaccaaatttaccaggtttggctggaggagttttgtgactcatcttttactggtttgaattttttcaaaccagtggctgatacctgccttgtacttagtaccttaataccaataacctaatggtacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacaccttaaaaaaaaagaaagcacgaaacacaccagacgcaagaaacacgagatgaccaaccagaacacaggacaggaacaaaacagtgaagggcgccgggccgagaaaaataaacggaggggggcgcagaaaaagcgagcgaagaaccaagagaggggacacaagcgggggcgcaaacatggcggaggacaacagagcaacgggaacaaagaccgaacgacgagacgcaacgcaggacagtcacatgtgcat

SEQ ID NO: 354615 - DNA, 2748 bp, Homo sapiens
agcgggctggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctca

SEQ ID NO: 354616 - DNA, 1847 bp, Homo sapiens
gggccccagaaaaatatgtactaggtacgagcctggcttgtttattttcgagtcaccgggctttctgtcgctgtctcactctggggcaggatcaagtctgctctctggagtggggctgcctgcagtgcagctctgcacacctgaacgtgttctttgtcacttgtttggaaatgatgtgattgaagatttcagagaggtcattggaggcttttctgtgccggcactgaatgttcatttgcatgaggaagttgcaaacgacttctgcaggctgagattcaaggcaggtggtattggggtccctcagcccacctgggccgtgacctcaagtgtccactgctgagtgtgagtggctttgcaggcctggtggtgggagagcctcaggctccctccttcttcgttcctgaccatgccctgggccccttcagtctgcctgcggctctgtggcatccctgccctgacactgggcacctgtgcccctagcaagcccacctggcacacgaggagggaggggtgggtggccatgtccttcctctagccacatgccctgctggccgctccattctgagctttgtgcagaaccgggtctgagctggagatttttctctgagaacctgcagttgtgcttgcagccgcacgcaagggcccttcagccgctggctctggcttccctgactcctcagggcgtgttcacccccaggctttctcacctgcacacggttaggccattttcagtgctcgtgggcagtcacggacagcagcagaaactcctcagcccctttgttacttcagaacgcctgcccacatgcatcttctgagctcgtgttgtcctcatggccgtggggtcttgggtgcgaacaggagatgctgagctgtggtccaccgtccaaggtgctgcagaaagcagctaggctcttttaggatgtttctattctggttgctgccttcgtggtgtaacttttaagaacacttacgggaatgtgctcatagaaccatcacctgtcctgagaataaaactcctggaatcatgatcaagtccagtgttaacgtggcccaacctgtctgtacttctggggagagaccaggaacatcactggactcctcatccccgtaattatttagagaagatgcaagcagcagatagtctccatgcggctggtactttttttgttgttttttgagacagggtcttgctctgtcacctgggctggagtgcagagcggcgatcatggctccctgaggcctcaacctactaggctcaagctgtctgcccgccttagcctcccaagtagctgggaccacaggcacccaccaccaccatgcttggctaacttgtttttgtagagatggagttttgccatgttgctcaggttggtctcgaactcccgatctcaggtgatccacccgcctcggcctcccaaagtgctgggattacaggcgtgagcccctgcgccccagccttggggcctgtctttgaatgggaatgagactgtgcaaaccgtggactaccctgtgtcacccacagctcagtggcctgcctgccggccctcaggggctgctgaccgggagaccagccagagcacgagggggtcagggctgtgtgggttttggcctgattctgcatttggttgtttctgggggccatgtagcctgcctgcattaggaaagcgctgtgccatctgatcatgagcccctctgcaccccctggtaaggtgaccttgcagcaggagctgtgccctgcctgggtaggcacccactaggtaggaccggagcaatcctggcagccgccacctgcacccgtgcacttgtttctcctcacagtttcaagtaaatccgtttttgaaggctag

SEQ ID NO: 354617 - DNA, 426 bp, Homo sapiens
cgcatgctcccggtcgtgccccagccccgcccagcaccgctgggcgcctgaggcccctgagattccgaaatttttaacctctgaagctgtgccttcacatgatctaggacagcgttcagaagatggctacagtctgttggtttgtattctgtgaaaatagaaaaaaaaatccggaaatgaccataaccgtggggaaatgatgtaactgctaagaattgaatgtgatggcccagcttgagtgatcttctgctcagaccacaccctggactgaaccagcctcctgtttccctcaggcctcctgaggtccctgatctccggcaagtgatgctccttctcaccatcgtctgtgccattgccttgaaaactcccttcctggcctcgcctactacatgagccagggacaaccagctgtccttttattctttt

SEQ ID NO: 354618 - DNA, 5975 bp, Homo sapiens
agcgggctggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagttccggcgcatcctccacaccgacaccatctggaggaggcgttgccgtgaggagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctcaattacgcttccagtgtttgggtatagaaatagcttccacccatcatgtctcagccatgggctgttggtcagttcatgtggctcctggttctggtgtgtatgttgggggcgggggtctctccatggtggtgacctgcagtgatgccaggcagggccagagccacacagccaggaaagggaggcctttttggccgcacagccagtcccttcagtcgtgactacaggtcttgttttttccgctccgatgtgtccttagccagttcttggctccggttctgtagggacaggcactgaatctgcgcgcctcaaaacagcagcttcccttccgggggagggcatccaccctctcaggggatcctgcaggtggcccatttcctgcaggtgagaactcggaagggctgatgtcgtcatcagaggcctaagggcagctgagagttggataaaaccgtttccaaggaggaggctgagtaacccagttcaggacagccaagcgcattaggcttgattggggaaggtggcaggtggagttgggaggttgggactctccatcttttgcaccacggatgcctttctgtcgctgtctcactctggggcaggatcaagtctgctctctggagtggggctgcctgcagtgcagctctgcacacctgaacgtgttctttgtcacttgtttggaaatgatgtgattgaagatttcagagaggtcattggaggcttttctgtgccggcactgaatgttcatttgcatgaggaagttgcaaacgacttctgcaggctgagattcaaggcaggtggtattggggtccctcagcccacctgggccgtgacctcaagtgtccactgctgagtgtgagtggctttgcaggcctggtggtgggagagcctcaggctccctccttcttcgttcctgaccatgccctgggccccttcagtctgcctgcggctctgtggcatccctgccctgacactgggcacctgtgcccctagcaagcccacctggcacacgaggagggaggggtgggtggccatgtccttcctctagccacatgccctgctggccgctccattctgagctttgtgcagaaccgggtctgagctggagatttttctctgagaacctgcagttgtgcttgcagccgcacgcaagggcccttcagccgctggctctggcttccctgactcctcagggcgtgttcacccccaggctttctcacctgcacacggttaggccattttcagtgctcgtgggcagtcacggacagcagcagaaactcctcagcccctttgttacttcagaacgcctgcccacatgcatcttctgagctcgtgttgtcctcatggccgtggggtcttgggtgcgaacaggagatgctgagctgtggtccaccgtccaaggtgctgcagaaagcagctaggctcttttaggatgtttctattctggttgctgccttcgtggtgtaacttttaagaacacttacgggaatgtgctcatagaaccatcacctgtcctgagaataaaactcctggaatcatgatcaagtccagtgttaacgtggcccaacctgtctgtacttctggggagagaccaggaacatcactggactcctcatccccgtaattatttagagaagatgcaagcagcagatagtctccatgcggctggtactttttttgttgttttttgagacagggtcttgctctgtcacctgggctggagtgcagagcggcgatcatggctccctgaggcctcaacctactaggctcaagctgtctgcccgccttagcctcccaagtagctgggaccacaggcacccaccaccaccatgcttggctaacttgtttttgtagagatggagttttgccatgttgctcaggttggtctcgaactcccgatctcaggtgatccacccgcctcggcctcccaaagtgctgggattacaggcgtgagcccctgcgccccagccttggggcctgtctttgaatgggaatgagactgtgcaaaccgtggactaccctgtgtcacccacagctcagtggcctgcctgccggccctcaggggctgctgaccgggagaccagccagagcacgagggggtcagggctgtgtgggttttggcctgattctgcatttggttgtttctgggggccatgtagcctgcctgcattaggaaagcgctgtgccatctgatcatgagcccctctgcaccccctggtaaggtgaccttgcagcaggagctgtgccctgcctgggtaggcacccactaggtaggaccggagcaatcctggcagccgccacctgcacccgtgcacttgtttctcctcacagtttcaagtaaatccgtttttgaaggctag

SEQ ID NO: 354619 - DNA, 5509 bp, Homo sapiens
acattgctatgtcaggccgtggtaatcggaccgagggagcagatattgggcatacggaggactgtgaacgtgtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccacacaggtgccaggagtgcccatatgagatgacgaggaaacccctttgcaggtgaggggacagctttctagaaaagccacacctgcatctggggacacactttggaaagtgggaccctccagcctggagaccccatggactgatgcctccactgctgtgtgccccatgttgtgttaacacctgcgtgtggggaccccatctgaggtcttggctgaggttggcatctcctgaagaacagagagcacggtgtccagagctggcccttcccccagcccacagccagctccgtgcccgagtgggcgtccccagcgagccttccctctctgccgcttgtccttgtgtctgggctgctccaagtccttgtgctgggcaccctggacacgtcctgctggtgagggacctcgggaaggtgacagtctgtgtgccttggtgtggagaccaacctgaggatgtcctgggaaatgttttcctgatgaatttctccttgactggcctttaaagaacataagaattcccattgcccagcctcagtgcatttggcaaatgcttactttgcttcccagagtcagagaattggcaaaggttcctaaatggtaatctggccggcctgggagaaagactcacgagaaaagccagtggagaaagcgcccttccagggcggcagcagcgggagccacgcagaccccgaggcgcacctgctggctcttgtgtgtggccccagtttctagcggcttttgcagcattagcctacaagctttgtcactccctgccctctgtggtggtcactgtttttctctcttgccaaatgaggcagtctctgagtgacggtgactgtggccttgaagcctggaggactgttgggcatgtagactggcaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctcaattacgcttccagtgtttgggtatagaaatagcttccacccatcatgtctcagccatgggctgttggtcagttcatgtggctcctggttctggtgtgtatgttgggggcgggggtctctccatggtggtgacctgcagtgatgccaggcagggccagagccacacagccaggaaagggaggcctttttggccgcacagccagtcccttcagtcgtgactacaggtcttgttttttccgctccgatgtgtccttagccagttcttggctccggttctgtagggacaggcactgaatctgcgcgcctcaaaacagcagcttcccttccgggggagggcatccaccctctcaggggatcctgcaggtggcccatttcctgcaggtgagaactcggaagggctgatgtcgtcatcagaggcctaagggcagctgagagttggataaaaccgtttccaaggaggaggctgagtaacccagttcaggacagccaagcgcattaggcttgattggggaaggtggcaggtggagttgggaggttgggactctccatcttttgcaccacggatgcctttctgtcgctgtctcactctggggcaggatcaagtctgctctctggagtggggctgcctgcagtgcagctctgcacacctgaacgtgttctttgtcacttgtttggaaatgatgtgattgaagatttcagagaggtcattggaggcttttctgtgccggcactgaatgttcatttgcatgaggaagttgcaaacgacttctgcaggctgagattcaaggcaggtggtattggggtccctcagcccacctgggccgtgacctcaagtgtccactgctgagtgtgagtggctttgcaggcctggtggtgggagagcctcaggctccctccttcttcgttcctgaccatgccctgggccccttcagtctgcctgcggctctgtggcatccctgccctgacactgggcacctgtgcccctagcaagcccacctggcacacgaggagggaggggtgggtggccatgtccttcctctagccacatgccctgctggccgctccattctgagctttgtgcagaaccgggtctgagctggagatttttctctgagaacctgcagttgtgcttgcagccgcacgcaagggcccttcagccgctggctctggcttccctgactcctcagggcgtgttcacccccaggctttctcacctgcacacggttaggccattttcagtgctcgtgggcagtcacggacagcagcagaaactcctcagcccctttgttacttcagaacgcctgcccacatgcatcttctgagctcgtgttgtcctcatggccgtggggtcttgggtgcgaacaggagatgctgagctgtggtccaccgtccaaggtgctgcagaaagcagctaggctcttttaggatgtttctattctggttgctgccttcgtggtgtaacttttaagaacacttacgggaatgtgctcatagaaccatcacctgtcctgagaataaaactcctggaatcatgatcaagtccagtgttaacgtggcccaacctgtctgtacttctggggagagaccaggaacatcactggactcctcatccccgtaattatttagagaagatgcaagcagcagatagtctccatgcggctggtactttttttgttgttttttgagacagggtcttgctctgtcacctgggctggagtgcagagcggcgatcatggctccctgaggcctcaacctactaggctcaagctgtctgcccgccttagcctcccaagtagctgggaccacaggcacccaccaccaccatgcttggctaacttgtttttgtagagatggagttttgccatgttgctcaggttggtctcgaactcccgatctcaggtgatccacccgcctcggcctcccaaagtgctgggattacaggcgtgagcccctgcgccccagccttggggcctgtctttgaatgggaatgagactgtgcaaaccgtggactaccctgtgtcacccacagctcagtggcctgcctgccggccctcaggggctgctgaccgggagaccagccagagcacgagggggtcagggctgtgtgggttttggcctgattctgcatttggttgtttctgggggccatgtagcctgcctgcattaggaaagcgctgtgccatctgatcatgagcccctctgcaccccctggtaaggtgaccttgcagcaggagctgtgccctgcctgggtaggcacccactaggtaggaccggagcaatcctggcagccgccacctgcacccgtgcacttgtttctcctcacagtttcaagtaaatccgtttttgaaggctag

SEQ ID NO: 354620 - DNA, 2747 bp, Homo sapiens
agcgggctggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctggagctgccgcccgagctgctggtggagatcttcgcgtcgctgccgggcacggacctacccagcttggcccaggtctgcacgaagttccggcgcatcctccacaccgacaccatctggaggaggcgttgccgtgaggagtatggtgtttgcgaaaacttgcggaagctggagatcacaggcgtgtcttgtcgggacgtctatgcgaagctgcttcaccgatatagacacattttgggattgtggcagccagatatcgggccatacggaggactgctgaacgtggtggtggacggcctgttcatcatcgggtggatgtacctgcctccccatgacccccacgtcgatgaccctatgagattcaagcctctgttcaggatccacctgatggagaggaaggctgccacagtggagtgcatgtacggccacaaagggccccaccacggccacatccagattgtgaagaaggatgagttctccaccaagtgcaaccagacggaccaccacaggatgtccggcgggaggcaggaggagtttcggacgtggctgagggaggaatgggggcgcacgctggaggacatcttccacgagcacatgcaggagctcatcctgatgaagttcatctacaccagtcagtacgacaactgcctgacctaccgccgcatctacctgccgcccagccgccccgacgacctcatcaagcctggcctcttcaaaggtacctatggcagccacggcctggagattgtgatgctcagcttccacggccggcgtgccaggggcaccaagatcacgggcgaccccaacatccccgctgggcagcagacagtggagatcgacctgaggcatcggatccagctgcccgacctcgagaaccagcgcaacttcaatgagctctcccgcatcgtcctggaggtgcgcgagagggtgcgccaggagcagcaggaaggcgggcacgaggcgggcgagggtcgtggccggcagggcccccgggagtcccagccaagccctgcccagcccagggcagaggcgcccagcaagggcccagatgggacacctggtgaggatggtggcgagcctggggatgccgtagctgcggccgagcagcctgcccagtgtgggcaggggcagccgttcgtgctgcccgtgggcgtgagctccaggaatgaggactacccccgaacctgcaggatgtgtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggcttgcttggagtttggacagaagcatttcacctctgatctcagcttccccacctgtggagtgggtttagtgacctgagtcactagggaatgtcacctgaatgcacagcccagcccatgcacctgccccagcccctccagctttggagccaaggccatcgttccagccacttgactgtcctcgacggcctgttccagacagggcgtttgttttgtccatgccttcctccctgcacgcacacggcgtcaaaaccaagctgccggccactgtctccagaacgcaaggctccaggcccgtgtgtctgaagcagtgagtggtccaccttgaagattcaccattgtttaaataaaatcaagcaaatgcttttttaccaagagcccgagcctcgctctaagggacgcagtcctagaggcgtgccctttggggcttgaagagcacactgtgggacgcacgtgcttctgattaaaggaatctcagatctca
